United States Patent 7,745,391 (HUMAN THROMBOSPONDIN POLYPEPTIDE) - sequence listing, part 18

SEQ ID NO: 44342 - DNA, 2514 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaaaaaaaaaaaaaaaaaaaaaaaaaaaaaaaaaaaaaaaaaaaaagaaaaaaaaaaaaaaaaaaaaacgaaggaggggacaacaaaaaatatctgaccgcccagaggaggcactgagacaacaagcgagcaccccaattgttggtggcataggtgccccacagatagtgagcggatataataccacgccgcgggtggacaactagcacgcgtgggcaacgggaaaagcggcaccacgacgactcttgttggggggaacaaaccttgtggtcgagatggagcgataacaagaaatatttgggcgcccactcagcggctcaataataattatatggcccacggtggagtacaacgtttgtaaccactgacgcggagattaatgacggggcaaacaacaagattttagttcgtgcggggcacatatgaatcttgtgacgaccctaggagacaatgggattacaaacatatactacccgccgcggcataagaaaaaaacag

SEQ ID NO: 44343 - DNA, 1968 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggagggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44344 - DNA, 1875 bp, Homo sapiens
gtcaattcaaataagaatgaggccaaacttatgaaataagttttcagagcctcttgaatgttagaattgcagattgtggactggctgtgggccttgctcctgatttcatacgttgctttgttgttttggcttggcaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44345 - DNA, 1036 bp, Homo sapiens
acctagaggttccctcgaatcgacggttctcaagctccgaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagaccctgaaaattgttcggacagcagaactttcgcctttcattgtgttcattgcacctactgaccagggcactcagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44346 - DNA, 1787 bp, Homo sapiens
cctgcggggcggtgactggcccagccgcaccgcgtctcccgccttctccgcagccccgcaggccccgggccctgtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtatcgcatccattgaatactgtgaccgaggacatgtacaccaacgggtctcctgccccaggtagccctgcccaggtcaagggacaggaggtgcggaaagtgcgactcatacagtttgagaaggtcacagaagagcccatgggaatcactctgaagctgaatgaaaaacagtcctgtacggtggccagaattcttcatggtggcatgatccatagacaaggctcccttcacgtgggggatgagatcctagaaatcaatggcacaaatgtgacaaatcattcagtggatcagctgcagaaggcgatgaaagaaaccaaaggaatgatctcattaaaagtaattcccaaccagcaaagccgtcttcctgcactacagatgttcatgagagcgcagtttgactatgatcccaaaaaggacaatctgatcccttgcaaggaggcgggactgaagtttgctactggggacattatccagattatcaacaaggatgacagcaattggtggcagggacgggtggaaggctcctccaaggagtcagcaggattgatcccttcccctgagctgcaggaatggcgagtggcaagtatggctcagtcagctcctagcgaagccccgagctgcagtccctttgggaagaagaagaagtacaaagacaaatatctggccaagcacagctcgatttttgatcagttggatgttgtttcctacgaggaagtcgttcggctccctgcattcaagaggaagaccctggtgctgatcggagccagtggggtgggtcgcagccacattaagaatgccctgctcagccagaatccggagaagtttgtgtaccctgtcccatatacaacacggccgccaaggaagagtgaggaagatgggaaggagtaccactttatctcaacggaggagatgacgaggaacatctctgccaatgagttcttggagtttggcagctaccaaggcaacatgtttggcaccaaatttgaaacagtgcaccagatccataagcagaacaagattgccatccttgacattgagccccagacagaagccctgcagcagctgcagaaggactctgaggccatccgcagccagtacgctcactactttgacctctcactggtcaataatggtgttgatgaaacccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgacacatctgtgcaatagaatgatgtctgctctagggaaaccttcaaaagcaataaaaatgctgtgttgaaatgccaa

SEQ ID NO: 44347 - DNA, 772 bp, Homo sapiens
cgagtgggtcctgcttcggacaacagtagtagcagcagctgccttcttggacgcctttcagaaagtggccgacatggccaccaacacacgtggtgggaccaggaagattggatctgctctcaccaggatgtgcatgaggcacagaagcattgaagccaagctgaggcagttttcgagcgctttaattgattgtctgataaaccccttaagaaattacaagaagccttcgaccaagcgtgcagttctccacagtgggtgcctgtctcctgggtttactaagcttgtagaatgggggaacccactgtatgcccctctccagcatttggaattccacccgccttgctttaagacaaacagggctgctccaactagttttgtgtcagcttccagctctctgcagctatcctaattcagccagtaaggttcagtcttcttgctcaggctcctgaagggttgattctcctgatagatggggccccactgatctggatttgaaaaggatttctagaaattgggggtaagaagtactaccaaaatgtaactgctaatcaagggtgatgcacagcaaaagcaatggaccccatccctctaaagcctgccctcctttgccttcaactgtatatgctgggtatttcatttgtctttttattttggagaaagcgtttttaactgcaactttctataatgccaaaatgacacatctgtgcaatagaatgatgtctgctctagggaaaccttcaaaagcaataaaaatgctgtgttgaaatgccaa

SEQ ID NO: 44348 - DNA, 346 bp, Homo sapiens
aaatgtcttgtgaagatactatgtaaatatcctatttctcctcatcctttgcttactaatttttagcatgcttgttaactgaaacaattctactagctgattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaa

SEQ ID NO: 44349 - DNA, 361 bp, Homo sapiens
tttttatttggagacagggtctcactctgtctatttacaggcaccatcagagcacattacagccttgaactcctgggctcaagtgatcctgccatctcagcctcctgagcagctgagactacaggcacatactttactcttaacactgtgcaacgagtgctagaattttattcaattcacgactaccctctacctttacaccaagaaagagcatccattgggaaaaaggagccacaattttctctttgtcaagctgttttaagatatataacatgaatacttaaatactaaagggagggtcaatccagagacaaaatgaacataagagactactgagttaagatggatgtttattgagaca

SEQ ID NO: 44350 - DNA, 342 bp, Homo sapiens
ctgtaacatgtttttacttatcattgtatcttaggcaaattttcatagcagtacctgtagggtaactttactttttaaattagctacatggtattccatcatatgaattactataattatttacccaattcaagttactcccattttttttttcctgttagaaagcttgctgcagggatatgactactgattgtcccctcagtatccatttttcagccaggcacaatggctcacaccagtaatcccagcactttaggaggtcaaggggaaaggattgtttgagcccaggaatttcgagaccagcctggacaacatggcaagaccctgactctaccaaaaaaa

SEQ ID NO: 44351 - DNA, 376 bp, Homo sapiens
ggggcacattccctgcagtggcctgtgtcatacacagccaatttcaccttttcactgcctggttattctgcaaagtgcatcctagaatgaccttcctctctgagctcctcttcaaaattctgattctttctcaaactataaagcctctggcatttgccaagagccaaggccctcctgaagccacagtttgagaacaagcgaagaggcagacatgagaaagaagtaccacccctggcagggagagctgacacttcccaggctactgcatccttctcagggcccagaaatgaatgagaggtaattaaagcagaaagcattttgcagcagctcagctcagctcttcgaagctgccatggtcccaggatcagtggtgtgc

SEQ ID NO: 44352 - DNA, 386 bp, Homo sapiens
tgcaggccacttgtgatggagaaaacaaaaggttggaaggagctcggagaactggcctccgtgaccaaggaggttggcattggagacccgagtctgctcccagctctgcccaatgccttgtgaccttccatcatcacttcacagaggcagggccgtaggtgatgtggtgcgtggagccccggcttcacttcgccaggcccctcaggcccattttcttaggaagagggtacttgggtcactccagttgcttgaagagggttgcgttccccaactgaacatctgccaccctgggtggtcttgggagtcttgcgcagcttttaggaatcttttttttttttttggtgggggaaagggatcttgggagaaaaagtaacaggaaacttatt

SEQ ID NO: 44353 - DNA, 431 bp, Homo sapiens
aattttctttaaccttccatgtaaatagtgcgcattaagacatgaggtctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatg

SEQ ID NO: 44354 - DNA, 481 bp, Homo sapiens
aagaaagtcaaacctactttacagtaaaatacttggtaagtgagttagaaaaatgatctttttctcagtgagaagtgctattctgtggcattttgaaaaataatcttacttctgctccactgaagaaatctggttattaaaagagttattccttttataaaatcaaaatctgcatgtggcaatttttattcattgatatggctctcttctcaaaacacaaagaacaaatctaacttttcactcaaaaattaatcttaaagacacaatttatgctcttcctgtaagcagcctgagatgatctcttaaaatggtttactattcacttgacccagaacaacccaaaaaatcattcaaatcaagagattgaaatcttcgtgttcactttaagaacatccatgaagctacccaggcaatcaagggttatgtatatctgaaaagccaccaagtatctgaaagatgtgactttacagaagcagtgtgt

SEQ ID NO: 44355 - DNA, 336 bp, Homo sapiens
gacttactacaacataaattttttgttctgacattgctgttggctacatctgccattttcaaaacgggtggcaagacattaatttttttgctaattgtgcaaaagaatgtatagccttatattcccattagagagaaagtgctgtggacattagattcaactgatgtccatttattcaagaaatatagtgtcttgtatgggccagctattaagctaagtgttgggtatttggtatagaacgaaagaaaataattcattccttttaaaagcttatatcctagtgggagagacagctattaatcaggtaaatatgtcccattccagcaggtgtagcta

SEQ ID NO: 44356 - DNA, 283 bp, Homo sapiens
gcagcctctgatggtgctggtgcccctaagggaacacagttctgcaagtgctggaaaaactgcaaactgggtttggcacctccgagaatgaatgctgctgctgaggtacagaggcattgctgggtggcacaagaacaggaaacaggcaggagccagttctatctttctccaccaccttctcagtctctctatggcaccccctggtggcggagcctcacatggaacccagtggtaaagtccagccccagccccagccccagccccagccccagtttgggaaaca

SEQ ID NO: 44357 - DNA, 609 bp, Homo sapiens
tacttgagtctccgtggaaaagaccttatcagggactgttagcaacttgcacagcaataaaactccaacgggacacttaagttcccatttcccaacttaaaaagtcagtttatcctgactcctggatgtccattccatcgggacactttaaattaagacattcttagaagccctccagaaactgctgactgcagaagtggccagcttcaactcaaggttaattttctgattcttagcagcccttttctttcctttcactctcctggctcatcttgcctattgtgctttacactctctctatgatactaacagacgaaaaggcttctcagtgtgttctcccttaccctcatcctgtgacttctgaacccttacagtcccctctcacttaagaaaaaacacagcctgggcaacatggcaaaaccccctctctacaaaacaagtacaaaaatcagccagacttggtggagtgtgcctgtagtcccagctacttgggaggctgaggtgggaggatcacttgagcccaggaggttgaggctgcaatgagccgtgatcgtgccactgcactgcagcctgggtgacagggcaagaccccatctcagaaataaatta

SEQ ID NO: 44358 - DNA, 410 bp, Homo sapiens
tcgcaaaggagaaattctcagcgcctttcttacagatttctggagaaggagagaaggagtcacaaaaacatcttagtaacattatttccatttctctcaacccttagaagcaataaaaagtctcattttctgtccgtttttaactctgcagttaaaaatgtatttcttttaccttggggaaatggcacaaaactagagcacactcaaacttttctatgatacattcttaaaatggggaggaagtgagcctaaaacccacggggaagggccactcagacagagaaacctctgccttattccagtgaaactggagttagcgagttagcacgggacagagactcctcagttcacctgagttcctctcctcgggccttttctcccctcagggcaccacacaggctttgagaatg

SEQ ID NO: 44359 - DNA, 366 bp, Homo sapiens
tcctgcagaatgtcgaagaaacctcaggacccacctcaacaacccaaagataacaacattaacgataaaaatcatgatcgtgtatatgggccggccgcggtggctcatgcctgtaatcccagcactttgggaggccaaggtgggcggatcacctgaggtcaggagttcgagaccagcctggccaacatggtgaaaccccgtctctacaaaaatacaaaaattagccaggcatgatgatggctgcctgtagtctcagctattcgggaggcggagggaggagaatcgcttgaacccaggaggcggaggttgcagtgagctgagattgcaccattgcactccagcctgggcgacagagcgagactctgt

SEQ ID NO: 44360 - DNA, 726 bp, Homo sapiens
taattaacattgccttgaagacttctggacaccgagactggcctcagaaatagttggcttttttttttttaattgcaagcatatttctttgaatgactccagtaaaattaagcatcaagtaaacaagtggaaagtgacctacacttttaacttgtctcactagtgcctaaatgtagtaaaggctgcttcagttttgtatgtagttgggttttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttcatggtctttttaatgttttctgttgttaaacatttcaagatttattgattttttttttcactttccccatcacactcacaggcacgctcacactttttatttgccgtaatgaaccgtctagcccctgtggagatctcctatgagaacatgtgttttctgataactcacaaccctaccaatgctactctcaacaagttcacagaggaacttaagaagtatggagtgacgacttcggtttgagtttgtgatgctacatatgataaagctccagttgaaaaagaaggaatccacgttctagattggccatttgatgatggagctccatcccctaatcagatagtagatgattggttaaacctg

SEQ ID NO: 44361 - DNA, 1897 bp, Homo sapiens
acctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaa

SEQ ID NO: 44362 - DNA, 1843 bp, Homo sapiens
acctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttatcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaa

SEQ ID NO: 44363 - DNA, 958 bp, Homo sapiens
ggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccagcttcagcctttgcctaacaccgcaaggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaacttgcct

SEQ ID NO: 44364 - DNA, 1109 bp, Homo sapiens
ggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaaggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaagttaagggtcaggcagggcacttagatctctcaagttgcctgcctgacccaagtgtagtgtacttccttttgttcctgctctaaaactttttaataaactctcactcctgctctaaaacttgcct

SEQ ID NO: 44365 - DNA, 1056 bp, Homo sapiens
ggtctcaccaaagccttgaccataggcagagggtaccagtggaaaaggtggggtgaagaacattgaggacaaaaggaagaagtgcaggaaggccctgaggcaagggagtggggggtgccctggagggatggcagcagggcagtctgtcagacccaagtggcctccagccctagaagccaattagtcctcctcaaaaagctgtcactgtcccctaagaattgctgccaggctcccactggcctgactcagtctttgagagtcttaaggaggaggtctctgaaaggtacacaccaagaactctccccagcacagctgtttttaagactctccaccagcgtcattggcgtgttgggaagaaaccctctgccacagaggccagcttcagcctttgcctaacaccgcaaggcaaatggaaaggtaaacgggaaggagatgtctccccagcaggctatttgaggacagtcttccctgcagaagatctcaacctggggtccacagagtggaaatgttagagtagggagctaggcaaacatgagcaggacaggtgagggcccccacaggaatgtcaggctaccatcaggtgatggtcaggtggttgttaaactgtctctgtaaaataataattggttgcagccagctccaagcaaggacagtctctcaatagatacaaaacaccctgatctggtgatcagccgcttcccgataagatctcaggagctgggcaagcagcctggagcatgcgcaccaagaggcaaaatggcggaatttaaccagtatatgacctaccttcctctgggaacgcacgactggtaaggggaaaaatgcctcaagtgagcatgcgcgcaacttcagtaatcacactgtgcatgcgaccccttccaagtgctggcaggtcaccacatacgcggacagcctgctgcaagggaagaatcaggggagatgagacgtaaatcccagaactatgccaaatacataaaaccccaatgtagtgtacttccttttgttcctgctctaaaactttttaataaactctcactcctgctctaaaacttgcct

SEQ ID NO: 44366 - DNA, 359 bp, Homo sapiens
ctccaccttaggagaggatagggaagagtaaagaggactttacttgccacttggataccagtttagccacagaaagacagggcactaggcagagtcctgagggccccatcccagaccttaattccaggatgacatttctagacacaccctgggccaaaagggaatccactgccttgaaggggagaacccagtcctggcaggattcatcatctgctgacaaaagagcccttgggccttgaactttcagcagtggtagctgggcagtactcgctgtgggccttgggtgagactcaaagacatgctggcttcaggtgagacccagtacattcccagctgtgatggctatagggagagactcc

SEQ ID NO: 44367 - DNA, 337 bp, Homo sapiens
gagacggagtctccctctgttgtccaggctggagtgcaatggtgcgatctcagctcacggcaacctctgtctccctggttcaagcgattcttctgcctcagcctcctgagtagctgggattacaggcgtgcaccaccatgcccagctaatttttgtatttttagtagagacggggtttcaccatgttggtcagactggtctcgaactcctgacatcgtgatccacccgcctcggcctcccaaagtgctgggattacaggcatgagccaccgcgcccggcctacaattcattcttaagtttctctaacaccaatgatactagcaccatcctcctcatg

SEQ ID NO: 44368 - DNA, 552 bp, Homo sapiens
  misc_feature (190)..(190): n is a, c, g, or t
tgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttanccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaa

SEQ ID NO: 44369 - DNA, 499 bp, Homo sapiens
ctgtgattttaatctagaacactgaatgtaggtcagtatccaccccattttcagaaatctgggaagatctttttttgtttttcagcttctcagaataaatactttctaggatgttacaaacatggatgaagttcaccagaacagatccagggttaaccttttaaagtcattagatatggctccagtaaaaggcatgagaaggcacccgtgagaccctgcagaggaagcctcactcctgggcagccttatggctgacgagctaccttactgagcatattcctgcctctacaccagagactcactctgtggtccggtgtcacctcgattctaaattccctgcttcctggtgaatgatgctatcacactttagaaacctggccaataaatgctttgaaatttaaggatagctatcctgaaaaaatttaatataacctaaattgatagtctaatgacatcagtattcagaagaggcattctatttcagcaagtggttttcaga

SEQ ID NO: 44370 - DNA, 267 bp, Homo sapiens
cgtatcagactgggcaccagagctcctgctgggagtcttctccaagtagtggcaagaactgcaactcaagaataagggcaactaaattagcatcccagagttagaaggtccttttgtttaaaccagtagtttttagcccatgatcttttacaagccctgcatgcaaactggctcctgggttcctcagtcactgaatgtcaaatgcggtgagatgctgaggtggtgctgctaaagttagaatgctcaaagttgccaattaattctgtg

SEQ ID NO: 44371 - DNA, 397 bp, Homo sapiens
gtcttctccctgtgatgtaacccagtggtaagccactgagattaaggtgtttgtatggggtaaccctctggggccattgccctcatgggacaagatctgctgccattaaaagagcggatagctatggcacattctgtgtgtctctcactatcctacttagtattttccttttaacatgtgccaatttgtccagggctctttaaaagtgtggccctaaaaactaagcagaagcctgagcaacaaaaattagccagggtgtggtggtgtgcgcctgtagtcccagcaacttgggaggctggggtcggaagatcaattgagcccaggaagtggaggctgcagtgagccaagatcacaccactgcaccccagcatgggtgacagagcgagacactgtgtca

SEQ ID NO: 44372 - DNA, 425 bp, Homo sapiens
agctgctttgtattaaaacagacctatctcaacccagtagcttagcagtcaggataattattttgatgtggcatattgttgttgttagtagactgaaaagaaatctaacatgttaatataactagaggaaggaaatgagagaaaattataatagaattatcttaatttttgtatattagtgttcagtctttgtgggcatgtttttaatagttattctcctagcaaacatcattttatattttctgttttagcataaacaagtttcattcttactgatgtgtgttaaattgttcccccttttatacttcagcttgttcccagtttttgataatgtagatacaaatttaaggaatatttatatgtatataactttttacttttaaaaaagttgtgacaaaatatacataaagtttatcattatagcc

SEQ ID NO: 44373 - DNA, 420 bp, Homo sapiens
gttaaataatcttttttatactagtctgacctggcatatatactagtctgacctttttatactagtcttccttcaccagtgcttcttttacctctcaaataaactgctttgctattgtatctttgtttcaaggtgagtttttggtgtaacccgaactatggtaatttttttaattctagtatttaactctctctctctctctctctcctatatatatatatacatatatatacacgcacacacatatatatacatatatatacacacacccccatatatatatacatatgctagtctgaccctagcatttaactttattttataaggaaactcaccctggtaaaggcatttgaattccattgtaacacaacctgtggtgttaagtttgtgcatttgtaactaaggcaagcaatttgattt

SEQ ID NO: 44374 - DNA, 385 bp, Homo sapiens
actattgttcaaagatgagatacaggaccgtttgtttcccttatattgagctgattttttcagcacatttaaaataagtaaaattgcctgccatctttatagcagttgatactttttgaattgcctaccagaactaactgcccaatcaacaacaggaacacaggccatatgcgacagtatgagctaaacctcatgtctctagttaacttcaagactatcacaaatttttttaatgaattctgattctcttttgttaaaaatgaattgccattgaacactttggggctttgtgcagtaaaaaaaggtttggttcttgctgaattgttgaatccatatggcagggaagcagctaggtatctgctaaaatgggcccctgcagcgtgtc

SEQ ID NO: 44375 - DNA, 555 bp, Homo sapiens
ggttacaaatgtttcacaagacagcaagtgacctgagaatattcatttggtttccaaagcaaactgccttgctcctttggggtgatttatggtatagaagaaactgacttaacatatactatagggaaaaaataagccatgaatcagcaagccaggcctgcgggaaaagtatgaacccaaacaggaaagggctgaggcaggtggtagggctggcacttatttcttccatctgcctcagagtttatccaaattttgaattttccgtaccttaaccatgcctaaatgctttggcttgttcaattttggcagattaagcagttcaaggtaagcagagaagtaagttcccaaccacaaggaatttaaaaggagtaggaacgtactttgaactacatttcccattttgcgatcattacgtcttctattacaatgccctactttggcagcatgaagagtactgcattaatttaatttaatttaaaatttaatttaaaactgtctttctctgtattttcaggagtttgaaaattcaaaaaataaataataaatgtcaataaa

SEQ ID NO: 44376 - DNA, 358 bp, Homo sapiens
atacctgtgaaacagaataaagaacctagaaacagactcacgtacctgtggacactttgtgccagatagagcactgtagaggaagcagatggtgctggtgcagctgggaatccaagaaaaaactggaacccttccttaaaccatccacaaaaataaattccaggtggagtaaagatctccatgtgaaggcagagcaaaggtttttagctttgagaactcagtcattctttaatctgtacaagcgaccttagttatagatgagctctaggatttcttttcttttttttctttctttcttttttttttttttttgagacagagtcttactttctcacccaggctagactgcaatggcgcg

SEQ ID NO: 44377 - DNA, 368 bp, Homo sapiens
aacaatatgaagaaaatgcaagaatatgtatatttaagtcacatgtatcaatttaatatacaaacttttatatatattataaaatgaaaatggttgatgttcataatgagagtatttcttgaaacccataaaattctaccctattgcttatagcaatagaacaattttaataagaactgatattagaattattgtggttaaacatttttgcatgaaatttgtacattaaagaaaatggagttaatgtgtggcacacattaatagtttagatgttaataaattcaaacacaatgaagaactcgaaaaaaaaacaaaaacacacatacaaatagatgttagtaagttacaactgctgcttaccaagtaca

SEQ ID NO: 44378 - DNA, 421 bp, Homo sapiens
agccaccagtaaacaactccagtccagtgtgccaggtagcaggactggggccgggccagggtgcattcttcaaatgcctctaccagatagaacaggcatgctaaaggcagatgagggggacccagaaggaccaacggaggagatacactatatcaaaagccaggactggcttacagggcccagcataaaatgaaaaacacggagccccttgcttaaaaattaagaattccaagacagtgacagcagcgcattaaaccaagtgcgtgctgcacgggtcacatgcctgtgaagctggccctgattaaagtggacagtttgggcctgaaacagagccctttgaaggacaggaccagagagaaggaagcttagagtaagaactgctccttctttttctagtacttcctgaggcaacatggaaagg

SEQ ID NO: 44379 - DNA, 384 bp, Homo sapiens
agacgcgttcgagaatctgaaatgactatcttggtccctatctaacttagcaaaaccttaaagaatgattcctggttgaaactaaggcaatcaatatggtcataggtatcacttatttcctaaagggagctcaaaacagcctcctactctaaggtatataattctggaggaaattcatcctggaaaatgcagctacctactgtgagaggaaaaaaatgatcctaattattaaggtcatatatgcaaggcaacgttactctgaaggtgctaagtgaccattaacactacatttctgtaatcttcaggtagctccacaatattgaaagcctcctctagcaaaaactgcactagtcacaacttcccacccagttcaatttccagatc

SEQ ID NO: 44380 - DNA, 617 bp, Homo sapiens
taaataactttcatttgaagctgcaccatttttcttcccatcttcaagttattaaaaaaacctagatccctctgcttaaaatacaaatgccaactccccaaatattaactgtaatgtagtatgtggaaaaacttctgtagcattgtatttagtctggtatgaagttggattctggaaggacaagacaaatatgtacagttttccctcagtatccaagggggattggttccaagaccccaagacccctgtggataccaaaatctgtgcatgcaccagtcccacagttggccctgccagaaccacatacacaaaaagtagccttgcctttggtagtggatgtgcaactcacggataaggagaactgactgtacttattggaaaaaaaatctacttataaacagacttgtgcagttcaaacccatgttaagggtcagctgtatttataataatgtctttcagaaactgatctatttctgtgttaaatgataatggagaattggtttgtatagcatgaaggggatttccttagaaaagtgtttcaagtggaagttgctgatggaaactcgtgcttcttgtgagcatttctattatgagaagtatggataaaatagttggct

SEQ ID NO: 44381 - DNA, 433 bp, Homo sapiens
gtgctcaaaaaagagaaaaatgggggctgaacttgtctttttatcatgcctgtgataatgaatccactcttgtgataatggcattaatccacccaggaaggcagaaccttcatgacctagtcacttcttaaatgttccaccagttaatactgttacgatggcaattaagtttcaacatgagttttggaggaacattcaaaccatagcacaagatgtagaaaaagaaggcagtggtcaccaattgagtaagaaataaatgtcactagttacaaccttgtcatactggatgtgttggatcatccattttggcctcctttcacctccccacgggcccttctctgagtctctgaggtcttcaccctcttttttgcaatgaccattacctagggcttactcttcttattcctcagttaatgtcttcttgttcatactt

SEQ ID NO: 44382 - DNA, 517 bp, Homo sapiens
taagccactgatttagagagcaggacgtctggcttccgagcaggaaccttcatattgccagtgatgaaagagagaattaaatacgggtgatattgagaaaggcaagaagatttgtgttcagaagtgtgcccagtgccacactgtggaaaagggaggcaagcacgagactgggcctaatctccatgtctctttgggtggaagacaggtcaggccactggattctcttacacagatgccaataagaacaaaggcattacctggggagaggataccgatggagtatttggagaatcccaagaagtacatccttggaacaaaaatgatctttgccgacattaaggcagaaaagggcagacttgatagattatctcaaaaaagctactaatggataataattggacactgccttatttattgcaaaacagaaatgcctcatgacttttttatgtgtaccataatttaacagatctcataaaccagaatccagatcatgaatgactgacagatttttgttggg

SEQ ID NO: 44383 - DNA, 436 bp, Homo sapiens
caaatataaaacagactagggccgatactttgctgttttcaacacagaagtggaaagcatgattttacacttctggaataatttagagtgacatctggtggttgcctgtgagacaagaattgttgaagaaactgaatttaaaagcctataataaataagactaccagacataaaaagataagaacgatgaattaaagtagtaaaaagtttaaaaaacatatcttaaatcctcactaaagaaaaattttaaaaaatgctagttgcagattttcaatccactggactttaaaaagaaacaatagattccttaatgagtagttgtaacgaaaattgtaacagttaattgatggcaggaaatacgaattgatttatactggtttgaagattctggcttgagaggaaatgcaactttacgggggaagaagactcaaacgtt

SEQ ID NO: 44384 - DNA, 563 bp, Homo sapiens
aggaagcttctgccaggccatgcgctcccttccctcccttctccctgtggctccaggaagcatttatcacaggtggaatatcccttgtcggaaatgcttatgaccagaagcatttcagattttagacgtttttggattttggaatatttgtattatagttaacatttcagcatcactaatctgatatccgaaaatcactgttgatgattctagattagtgttttttcatgttttgtgcccaaaaacttcagagtttgtagcatttcacatttcagattttcagatcagggatactcaacttatgtctcttttctatggaagccctttctggaggtcctcgagttcaggccaggccctgtgcttttttgaggcagccctgccctccttcctaggcagctccagggtggtcagtgtcagccctgctgtccttcctttgcccagtcgtgggaagctggtcagattgaaaaagcaatgccagtcgggggtcatggcatagcagaccatattgtcagaaatctttggttgcaagggacagaaactcagttcagtctcacttaaggaaa

SEQ ID NO: 44385 - DNA, 1041 bp, Homo sapiens
ggagccttccaccacgactgcaagtttcctgaggctgccccagccgtgctgaactgtgagtcagttaaacctcttttctttataaattacccagtcttgggtatttcttcatagcagtgtgagagcagatgaatacactggccctgcctgggtttcagaaccagccttgaacctttcacagtggccagaggatggggaggcagaggcccaggttgcacacttcttgcctgagtgttggggactatctgacccaaaacaggtgcacagagggcaggagaggatgttcccaaaggaaaattagagtttagaatcaaaagaaggggaaggtgcgtgtttgggaggtaaatagcaaatactcttcataggttcactagagtcttgctactccaagtacgatccctgggccagcagaatgggcacagctggagctgattggataggtcccatgagcctcaggccccacccaggctcaatgagtcagagtctgcgtcttaagaagaccccctggtgatctgtgcacattcaagcatgctgccgttttccaaagcacttgcaacactcaggatgcttgcacggtcatgttgccaccatccaacctgcagaccccattcttgagattgactgggagttcctatcatgtcctccatagcaaggggatctagaccagaatcaagccttggatctagttctcaagtctcttttgtctctttcagtttaggaacagtttgtcaactttccttcacttttgtgaccttgatacttgagtttgaaggctgtctctcaatttgtgttctgcccagtgcatcctatcagaaggcatgtgatttcaacttctcccataccaacaacgttcactttgatcacttgattaaaggggtgtctgctaggcttctccacagccaagttactattttccctccctttataattaataagcattttgtaagtgggtactttgaaactatgtaaattgtaaactttccatttatgcattttaaaattttgattgatgtaaacttgtgaattcccattgtatcctta

SEQ ID NO: 44386 - DNA, 119 bp, Homo sapiens
ccaaacactttgggctgctggagaccgccctggaggaggaagacctggcctcctgcaagagccctgagtatgacactgtctttgaagacagcagcagcagcagcggcgagagcagcttc

SEQ ID NO: 44387 - DNA, 1377 bp, Homo sapiens
gttttcaaactactattcccaggaagacgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttt

SEQ ID NO: 44388 - DNA, 1390 bp, Homo sapiens
gttttcaaactactattcccaggaagacgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaacatgtaaataaaggaatagatttaaaagaaagcaaaaa

SEQ ID NO: 44389 - DNA, 1471 bp, Homo sapiens
gttttcaaactactattcccaggaagacgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacagcaaaaaacagcaagtataagcccttgaatattttttaaactggactttttatgttgcccttgcttcgcttcatctttgttttctgtgatttcaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttt

SEQ ID NO: 44390 - DNA, 1422 bp, Homo sapiens
cggccgctcaacatcagaatctgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacagcaaaaaacagcaagtataagcccttgaatattttttaaactggactttttatgttgcccttgcttcgcttcatctttgttttctgtgatttcaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttt

SEQ ID NO: 44391 - DNA, 1444 bp, Homo sapiens
gttttcaaactactattcccaggaagacgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactgcataatgtctgcagaataaaattaaaactaacaaat

SEQ ID NO: 44392 - DNA, 1395 bp, Homo sapiens
cggccgctcaacatcagaatctgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactgcataatgtctgcagaataaaattaaaactaacaaat

SEQ ID NO: 44393 - DNA, 1402 bp, Homo sapiens
aagcattgtatatccatgcatagggcccattacggccggtgaggctaaagtgcatggtgggtcgaatcactgtgtaactgtacgggagcatacatgggttgattcacgtagccgtgttgagattcatcatggaatagaagaccgcacacggcagggtaccagatcagtgttcgtccctggtcacacatggcgttctcatgtcctctgtggatcttgacgtaggagctctaagagcccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttt

SEQ ID NO: 44394 - DNA, 1051 bp, Homo sapiens
tctagaggatcatgatagcgaccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttt

SEQ ID NO: 44395 - DNA, 498 bp, Homo sapiens
gctctccataatcttatacctcactgtatttcagtgacttgattttgcgagtgttttctactggattgccgttcatcaggaataagacctcttacttttctgcccctggcacctcgaatctttcctagcacacagaaagggcattattcataaacgcttgttgaaggaagttaaagaaactgcactgcaactccgtttctcggtttcttaacagttaaaaggtgataaagaccaagcttggtggctgacacctgtaatcccaacacttaggaaggcaggtggatcactttgaactcaggagttcaaatgagaacaacctgggcaacatggcgaaacctgtctctaccaaaaaaaaaaaaagatataaaaattagccaggcatggtggctcctgcccgtggtcccagctactgggaggctgagatgggaggaccgcttgagtctgggaagaggaggttgcagtgagccgagatcgcaccactgaactccagaaaaaaaa

SEQ ID NO: 44396 - DNA, 535 bp, Homo sapiens
  misc_feature (469)..(469): n is a, c, g, or t
aaaatgttatcctgggtttacactgattgtcagataatacagtcatgcaccacataatgacgttttggtcaatgatggacagtgtatatgacggtggtcccatacgattattatgcagctgaaaatttcctatcactgtcatagctgtcttactgccatagagcaatgcattacgcaggtgtctgtggtgatgttggtataaatgaacctactcaggaagaacctcagacaggtccttcagaaggtatcgagaaggaggcattgttatcatagagatgacagctccatgcgtgcttttgcccctgaggaccttccagtgggatatgatgtggaggtggaagatagtgatattgatgatcctgaccttgtgcaggcctgggataatgtgtgtgtctgtgtcttagtttttaacaaaaaagtttaaaaagaaaaaaaaatttaaaaagcttgtaaataaggatataaaaanttttttgtacagctgtacaatgtatttgtgttttaagctaagtgttacacaaggataaaaaaaaaa

SEQ ID NO: 44397 - DNA, 342 bp, Homo sapiens
tttaaatttaaatctattaaaatcactgccccccaactacggcattaggctagattagtgacaaaaggcaaatagacatggctaaagccctcctagaagcatgactcactcctgagtcacgtcaggtgtcacacaccaggagcgggccctctcaaggccacctctgtctcagcaaagtctctgttctctaccacctccaccctacagatgtgcgtcttcagctgtgtggccgcttcaccctgttgcctcccttctagaaacccagtcggggagtgtgttgccacacccagtgggggtagtatcagaatagggtctagggtctcttcccgttctaaagtctct

SEQ ID NO: 44398 - DNA, 426 bp, Homo sapiens
gtggacttacctggctgtgagaggcagcagtgtgtggggcctattagaaatctccctgggctttgtggtcagggaggctgcatttcagtcccagctctgccagtgactgtgctgccatggcctggattcaccatctctcagagtcccttagtgccagtgtgtgacatggagatagtgttttacctgtgacctgctggccatgctgaggaaccgtgtccacaagtagctcagggcctggcacaccataagcactcacacatatgacaccaagaagagttgtttgtgaggaagaggagggaacctggggaggagtaaggggtagagagaagccaggagtgtggtgcctgtgggactgctttggaaggaatccatagtgaagggaaagtgcacccaagtgacaaacccagtgtattctggcttaagtca

SEQ ID NO: 44399 - DNA, 308 bp, Homo sapiens
aacctctgcctcccaggttcaagcgattctcctacctcagcctcccaagtagctggaattacaggcacctgctacaacacccggctaatttttgtagtttttgtagagacgagtttcaccatgttgaccaggctggtctcaaactcttgacgtcaaatgatccacctgcctcagcctccctaagtgctgggattacaggcgtgagccaccgcgcttggccctctctgcgcaattattgatatgtagcattttcacacttctatggccatgaaaccattttgaacctgtatcagaggcgcacactttag

SEQ ID NO: 44400 - DNA, 375 bp, Homo sapiens
gtcgacgtagtcagttaccattaaaaacaacttcatgccaataaatttggcaagttagatgaaatggacagataccttgaaagatactacatggtttgaatgtgtcttccaaagttcatgtgttggaaacttgatccccaatgcagaaatgttggaaggtggcacctttaagagctgtttacatcatgagagatgtgtctttataaatggattaatcccattattgcagaaatggttttgttatcatgggagggggtcattataaaaagacaattttgccaggtgcagtggctcacgcctgtaatcccagcaatttgggagatcgaggcgggtggatcatgaggtcaggagatcaagaccatcctggctaacacg

SEQ ID NO: 44401 - DNA, 324 bp, Homo sapiens
atccctgtagttgcctcagcagcccctcaagccacaaaaaccccagcaagtgacaaacctgcggttgatctttctgagcatctcctcacccttgatgagtacagtaacttctagtgatagtgaagaaagcagatcttcatagagttcttgaggcatatggcatggggactcttttgccttctgattttattagtgggcagacagcagagggaagaggctacattttttctttactggcacctgcttggcaggaacccagaggatgctcaacaaactgttttgaatgaataaatttatatagtgtaagacaatctgaattttctt

SEQ ID NO: 44402 - DNA, 421 bp, Homo sapiens
atatattcattgatgaaatttagagaacatttaaatctgtaaggaagaaaataataacgactcacaattacatcattgactgctaacattaagacacatttcctctcatagacagatgattagaaaaagtcactggagccagatgtggtggcttatgcctgtgatcccaacaatttgggaggccaaggccagagggttgtttgagcccaggagttcaagaccagcctgggcaacatagtgagactccatctccacaaaaaatttaaacaatttaggtgggcgtggtggtgcacatctgtatttttatctactcaggaggctgaggtgagaggattgcttgagcatgggaggctgaggctgcagtgagtcatgattacaccactgcactccaggttgggtgacagagtgagaccttgtctca

SEQ ID NO: 44403 - DNA, 848 bp, Homo sapiens
ggcaaggggagggaaagcattaggacagatacctaatgcatgtggggcttaaaacctagatgacaggttgatgggtgcagcaaaccaccacgacacatgtgtacctatgtaataaacctacacgttctgcacatgtatcccagagcttaaagaaaagatacagatagatagatagatacgtagagagagagagcgagctaaaaaaattgttttaaagtaaggcccaatgaaaaagatttagtttgagttaaagaaaaacctttcttaaatgacccatttaactgcacgagcttcatcctctggcactgttttacttcagctgaggggtcttgcccagagccatgtcccacctgctgtctccataaatgcagtgctcaggggagcaggactggctccccccctcttcctggccaccagcaccctctgtgaccttgcaaaagtcacattcacatctaggtctgctcccttcgttggaaacaagggagtcttcctgcccgtgttcttccacccaggctggcccgaaagttctgagaatcttgactgcactggcgtcgtcagctggagagtaagatcagtgaggtggcgatttgtgtccttcagtgcctcgctctgcacccgcctccgactctgctcagcgtggcctccagggctgccagcaccaaatgcctaatctcactgctctgttgatgcagcattacacttctgtacgagtttgcagtttgttcacctgttggaagcatggaaggactaaatacttggaacacactcttctgccccttgcttggaagttcagaaaactcctggtgatttataacttcatggtggatcactgctaaaatttatgacct

SEQ ID NO: 44404 - DNA, 488 bp, Homo sapiens
cttcccatcctgccatctctttgacccagctagtcagcattctctacttttaaatactttagtgattagattgggcccacctggataatcctggctactcttcccatctgaagggtaaccttaactacttctgcagagtcccttttgccatgtaaggtaacatattcataaatttaggggattaaggtgtaaacatctttgcagggtgtggggaggacattattctgccaaacaaagaaatgggctgtcagtctaattgtctttcctttgtagatgatttggctgttctctctagctgcttttaagatctggctgtttcttggaatgtatttcttatttatccttgtgaacactgactctcctccattctcttttaaaattcctactaagcacaaactagatctttcttcactctttctttctctctttctttcttaacagggtcttgctctgtcacccaggctggagtgcagttgctctatcatgac

SEQ ID NO: 44405 - DNA, 480 bp, Homo sapiens
cagtaccccacccctgagccaacaccatttctagcatgactgtgcgcacagtcaccagcaggggccccctgcgccctgctccagctgcattcccttcactactctggtgaacacccacatggagacaggcatcctggcacctactagcactctgccacagctgctgctaccactgctgctggcacatgcaaatgaggatggatcctgctgtcattgcactatgaaatgctttcattcacaccacctatcagagtgtagtgaccagcggtctgggaacaccttaggccccccccgaccccagcacagtggatttctaacctcgaggagccagagaacaaagagccaatgcaagtccgccagagttagagcacacagtcctggagttgagagctgagcagtggccctctaacaccttccagaaatgaagccagtctgctgaattcacctataccacagtcaaactcttatggtcatcaaata

SEQ ID NO: 44406 - DNA, 219 bp, Homo sapiens
cctggagcccagtgcgtcctccaccggccagactgtacaacggttggatcctgtgtccactgctaggacccaggctccacgagcacgggcttgtgtggcacacggatgcaccctaagtcctggcacagagactgctcaacaaaggcctcggtgcttttgtgtatgtttgaaattttccataataaaatgaaaaatgggaaaatgggaaaacaaaaatgg

SEQ ID NO: 44407 - DNA, 574 bp, Homo sapiens
gttttctgacagtattattgaatggttttgactattatcccttgaaataattgacctgtggaattgtcaagagttgtgtttccattttaatattatttttccaatgcaacagttataaacaaataattaacaattttttggtaccaatgaattattgaaggcaagagctagaatctctaactgcatgttagatatctgtatattaattagaggacttgcttcaaatgatagacacaatttgtgttagagatatcaatggggatgcttcagtaacagctattctgagcaactaaattatgcaaaagctttaggataaattgggtgggtgcagtggctcatgcctgtaatcccaggcaggcagatcacttgaagccaggagtttgagaccagcctggcaacataccaaaaccccatctctgctaaaaatagaaaaattagctgggcgtggtgccacgtgcccatagtcccagctacttgggaggctgaggcaggagaatcacttgaacccaggaggcagagattgccatgagccaacatcatgctattgtactccagagcgagactccatctcaaa

SEQ ID NO: 44408 - DNA, 555 bp, Homo sapiens
gtaagtgtgtgaataaaataatgaggacaattgccaaagagcagtttaggaagatgaatttttttagcattgtggtcacactggaggtaataataaattactatgataacagtaggggagaaaaagaatggatagtagaggctgggtgtggtgcctcatgcctgtaaccccagcatttggggaggccgaggcagatggatcacctgaggtcaggagttcgagaacagcctggccaacatggcaaaatcctctctctcctgaaaatacaaaaaaattagccaggcatgatggcgcgcacctgtagtcccagctacttgggaggctgaggcatgagaatcacttgaacctgggcagcagagattggcagtgagctgagatcgcaccactgcactccagctgagcgacagagcgagactccatctcaacagtaaaaaaaaaaaaaaaaaagaatggatagtagaaaagaaaagaaagttgaggaaagaattaaatgagactgtgtgaaaagaatagttagtggacaactggaatatttttatcttgagcacctgaaac

SEQ ID NO: 44409 - DNA, 427 bp, Homo sapiens
gccgaggctcccccgcctccgcatgctcgccgcgctctcccctcagtctctcgctcctgtttctcctcagattcgcgtcgggacgacgagccccgcgggaggattccagcctaggagggggccgggccggcgaaacggaaccgagcgggagtcagtgcccgcgcggtggccgggcggagcggggctgcgggagccgcccgcgcggcagcagaagcggcggcggcggcagcatcccccgcgctcggcgcctgcactcggagttgctgctgctggcaggcatgagtgttattatagtgagcggcgttgccggtccattgcactgagccaatggcagggagccactgggctgatactgagagctgtcagaggagtacatctgtcacccgctgcctcccccgcccaccccgccgccgggacccgcggccgc

SEQ ID NO: 44410 - DNA, 164 bp, Homo sapiens
tgttcagacctcacagtggtaattgctacaggcaagagctgccgatgaatgctgacattggtgggcagaactttaaggaaagagaggatatttgcataacctcaaaatatctattaattactggggtggctttaacatctgtccgtgggttctttgatactctt

SEQ ID NO: 44411 - DNA, 751 bp, Homo sapiens
aggaactggtagctaaataagaagaggaagagaggcctgagctagcattagcatgctcggcctccttgccatgtgatatcccacaccacttcgggactctgcagagagtctccaccagcaagaaggccctcaccagatgcagccccttgagcttggcctctgtaactgtaaaaagtaaatttattttctttataaatgacccagtttcaggtattctgttataagcaacagaaaatagactaaaatatccagcaatctaacagaattgagtttatagataagggaaagggtttgtgacccacctacactatataaattctcccaagaaagttatgagctagaaactccatgtcaggccttggtgtggaaggtgctgtggactgaattgtgtttctccttctcccctcaaactcatatgctgaagtcttaaccccagtgtagctgtatatcaaggtaggatctttggcagatggtttaggttaaatgaggtcatgaggatgagaccctaatttaataggactgtggccttataagaataggaggagggcaggcacagtggctcacacttgtactctcaggactttgggaggctaaggcaggtggatcacttgagcccaggagtttgagaccagcctggacaacatggggaaaccccatctctacaaaaacaaacgaacaaacaaaattagcctggtgtggtagcatgcacctgtagtctcagctacttgggaggctgaggtgggaggtttgc

SEQ ID NO: 44412 - DNA, 309 bp, Homo sapiens
ccaaagctgccagattacaacctctaatgaaaaataatcacctacatagactcttttaccatcatggacagagagccttggaaaagaaagctctaaactcaactgctaacaggttgatgagtagaccctgaggaagtcccagtgtgtgtggcttctttgtccatgggattctgtggattacgggctgaggtggcttatgacacctctgcactgtattgcatgaagttactgcacacatatgttgtgtgaccactgatcacatggagcttttcgagtgaggaggtttggaaatattgttgacccttgaac

SEQ ID NO: 44413 - DNA, 387 bp, Homo sapiens
aaaaaaaaagactgtaactataaagcccacaataatcaagatagtgtggcactggcaaaagaacggcaaaatagatcaacaaaacaggacagacagccctgaaacagaacaataaaaatatggtcaactaatctctcacaaatgggcaaaggcaatttaatggagaaaagagagtcttttcaataaatgaggccaaatgaactggatatctacatgtaaagaaatgaatctagacacagattctttatacctgtcataaaaatccaaaatggattctagacttaaaacataaaatacaaaactataaaactcctagaagacaataaaaaagaaaatctatgtgaccttggttttggcaattacattttagatacaacagcaaaagca

SEQ ID NO: 44414 - DNA, 890 bp, Homo sapiens
gcagtgtcagttctgcatcaggaacccctcgcgctgtaatcctttgatatttttcaagccatgagaaaaatgaagtggacttaccagggtccctccagtgacctagtggatgttcttacaggactgccgtgtgccactggctgtggcttccctggtcctgtgcttggccaccgggagctggcatctccaaaatagagcctccttagcctgtgcaggtgggctgtcttccaaagtcaccacaccagtgacttgtgctgtgcggagccttcctcaccaggaccactggctgctcctgtggctagaagtcacaattataggcttcattgcaagagccagcatttgagtttcttctgggcacctgccactgtgcatgtgtgacctcaactgctttgtgcaccctgactggggggtaggtgctagcgttccaacattacagatgagaaaaccgaggcacacagaagaggtaacctgcccaaggtcacaggtgttaggtggcagagccaagatgttattgtcagtctgacttcaggtgcataaaacctgaggctgagcctccccatgagaggaaaaatgtgtttgtggtgtgacctcagttgccagggaacttgtgcaggaagccgggagagatggcacagacccacctgtgctcacagtacatgttaagaattcccaagtctcaggcaaaccatctccaagggtgttcacagaagacacaccttaaaggcaaacgggttcatgatgtaatcttctattgactagctgtgaacctcatttttcttatctgtgaagtgggaacagtaataatccaagtctttttatggagttatcaagatcaaaaaaggaatggatatacaaagtgttttgtgaaataaaagctccctaaaatggta

SEQ ID NO: 44415 - DNA, 1136 bp, Homo sapiens
  misc_feature (12)..(12): n is a, c, g, or t
  misc_feature (20)..(20): n is a, c, g, or t
  misc_feature (81)..(81): n is a, c, g, or t
agccttttgacnttgatttncggaattttaaaatacggccttcacttattggggaaattttggccctcgaggcccaagaanttgggcacgagcgccccaccttggcctcccaaagtgctggcattgcaggctgagccacggtgcccagcctgaacaccctttcctggtaaaacactccaaaaccaggaaaagaaggaatgtacagcaacaaaataaaggccagtcatgcaaggcccatggctgaaagtctttcagtcattttaggtgaaagactgaaatctttgcctccaagatcaggaataagagaaggatgcccgatctcactacttctattcaacacaggatttgaagtcaggctggtcacagtggctcacacctgtaatcccagcacttttggaagtcgaggcaggtggattacatgaggctatgagtttgagaccaccctggccaacatggcaaaaccccatctctacttaaaaaaaaaaaaaaaaaaaaaagatttgaagtcctagccagagcaattaggcaattaggcaagggataaaaaggcatctaatttgaaaaggaacaagcaaaatgatctctgtttgcaggtgacaagatctcatatgtagaaaatcctaagtattgcacaaaattacctgttgaatgaatgaattcagcaaagttccaggaaaccaatttaacatgcaagcaaaaatgtattacatttctgtgcactaaacataaacaatctgaaaagaaaattaagaaaacaattccatttacaataatgtcaaaaaataaagtaagatctttaggaataaacctaaccagggaggtgaaagacttgtacactgaaactacaaaacattgctgaacaaatgaaagaagacacaaataggtggatgacattcttgttcgtggagtggaaagattaatattgtcaaggtgtccatgccaccaacaacaatctccagatccaatgcaaatcctatgaaaaccccaatggcattgtttttgctcaaacaaaaaattcatcctgaaattcaaatggaatctgaaagcactaccacaaaccaaaataatctttagaaacgtgaacagagaggacacgcattccctgatttcaaaatgtattaaaaactatggtaatc

SEQ ID NO: 44416 - DNA, 1812 bp, Homo sapiens
tgcggtggctcacacctgtgattctagcagaaaatcagatcaggagatcacagaaggtcaaggaactactgagagagcaggaatggagagcaggggggtcagcaggaagcttggagaatctgcaaaatagtagattacaaaggatcaaaagtcagtgaggttcaacaagaggtagggtgggataatgaccaaagacagagggaacacttccaggttcattctgtgaggtcagcaacaccatgacctaaaagccagataaagaccctgcaagaaaaacaatacacaaaatacagatgaaaaggctggtgaatattgatgggaaaatcttcaacaaaattctagcaaaccaactttcacagcatgttaaaaggactgtacgccatgaccaagttggagatagccctggaatgcatgtatcacccaaaacaggaaaattaatgtagtgcaccccattagcagaatgaaggacaaaacccacatgatcatctcaactgatacagaaaaaacattggacaagattgaacacctttcctttttttttttgtgagatggagcctcgctctgttgcccagcctggagtgcagtggtgccatcttggctcactgcaacttctgcctcccgggttcaagcgattcttccacctcatcctttcgaggagctaggattacaggtgtgcaccactatgcccggctaatttttgtatttttggaagaaacgtggttttactatattggccaggctggtctcgaactcccgacctcaagtgatccgcccaccttggcctcccaaagtgctggcattgcaggctgagccacggtgcccagcctgaacaccctttcctggtaaaacactccaaaaccaggaaaagaaggaatgtacagcaacaaaataaaggccagtcatgcaaggcccatggctgaaagtctttcagtcattttaggtgaaagactgaaatctttgcctccaagatcaggaataagagaaggatgcccgatctcactacttctattcaacacaggatttgaagtcaggctggtcacagtggctcacacctgtaatcccagcacttttggaagtcgaggcaggtggattacatgaggctatgagtttgagaccaccctggccaacatggcaaaaccccatctctacttaaaaaaaaaaaaaaaaaaaaaagatttgaagtcctagccagagcaattaggcaattaggcaagggataaaaaggcatctaatttgaaaaggaacaagcaaaatgatctctgtttgcaggtgacaagatctcatatgtagaaaatcctaagtattgcacaaaattacctgttgaatgaatgaattcagcaaagttccaggaaaccaatttaacatgcaagcaaaaatgtattacatttctgtgcactaaacataaacaatctgaaaagaaaattaagaaaacaattccatttacaataatgtcaaaaaataaagtaagatctttaggaataaacctaaccagggaggtgaaagacttgtacactgaaactacaaaacattgctgaacaaatgaaagaagacacaaataggtggatgacattcttgttcgtggagtggaaagattaatattgtcaaggtgtccatgccaccaacaacaatctccagatccaatgcaaatcctatgaaaaccccaatggcattgtttttgctcaaacaaaaaattcatcctgaaattcaaatggaatctgaaagcactaccacaaaccaaaataatctttagaaacgtgaacagagaggacacgcattccctgatttcaaaatgtattaaaaactatggtaatc

SEQ ID NO: 44417 - DNA, 660 bp, Homo sapiens
aaataatacagagaggtctcttgtacattttgcccactttcaccgaatggtgacattttataaaactacagtataatgtcacaacaaccagaatattgaccgtgatataacctaccagtcatatccagatttctctagttttacgtgttctcatatgtatatatattaagtactatacaattttattacctgtgtaattttatgtatccaccactacagtcaagaagctgaacagttctaacacaacaagaattcttcatgttgcccttttatattcacacctccttccctctcacccacctcatcccctccttaacccttgacaccactaatctgtcttctaaaatttcgtagtttcaaaaatggaataatgtagtacataactttttaggattgtcttttttattgttttagacaggatcttgctctgtcacccagaatggagtacagtgtctcaatcatagttcactgcagccttgaaagcctgggcttattagctgggcatggtggcatgctcccatagtcccagctacttggaagactgaggtgggaggatctcttgacctgagcggcagagattgtggtaagccaagatcatgccactgcacgccagcctgggtgacacagcaagaccccatctcataaaaaagaaaatatgtt

SEQ ID NO: 44418 - DNA, 308 bp, Homo sapiens
attcagttcaatagaattgtatcttttaaaatacttatagtccttagatactgttttgttataaagtattttgttttgaagatgtctttaaattcactggcttcaaagataacttctgcattattccttgggctttcctcttagttcaatttagaaggaacagagaaaacacaaacatttaggtaaataatggaaataggattcacgtcataaaacgatactttgcaaaattgacaaggtggcaaacatacaggtgatgttagttttttgattaataacaagagacagaatctgaagggttagaggaa

SEQ ID NO: 44419 - DNA, 379 bp, Homo sapiens
cagcatcgtgtccccttcccgcttatatatcaagtcacactcaacaggaatgggggtttagcacatacatggctagggaggggaagaggctagagggctgtggttgctcaggattcaaatacaatttgcaaagaaagtaaatgtggatttacagttcttgtggaaatctattaaacagatgtcactgaagcataatcaaatcagcactatggcaattctacacttaagtctgatattggggttttgccatttttatgatcagttcaagtgtatgttttgtgatggtgcaggaatttgcaattaaggatgaaacctcccaagtatgatcaattaactaacgtgcctgaatgacaaacttacaaatgcaaaactccattct

SEQ ID NO: 44420 - DNA, 370 bp, Homo sapiens
aagaaaacaattttttgaggcagggtctcactctgtcgccatgctggaatgctgtggcatgactcgttgctcactgcagcctcaaactcctgggctcaagcaatcctcccaccttagcctcccaagtagctaggactaacagcgtgcaccaccacactcagctaatttcttttttttaatttttagtagacacaagatcttgctatgttgccaaggctggtctcgaacctctgagctcaggcgatccttctgtcccagcactttggaaggctgaatggggaagactgattgaggccaggagtttaagaccagcctggtcaacatggcaagatccctatgtctattaaaaaaataattttaaaaaagcaat

SEQ ID NO: 44421 - DNA, 333 bp, Homo sapiens
gttttgagaatgaagaaacaatagctctggagagatcatctttggaaaattaatattttcccccccaaaaaatacctaagaacatattgatttgaggtagctaggtaggtaaagcatgaaactcctaacctcgtgataatggaatacagcctcttttggagagttccattttaagtggcaccctcaaccattgatttgccttagttttcatattttagacacattcatgtgttcattcaaaaataatatttaattggccagccacggtggttcatgcctgtaatcctagcactttgggagccccaggtggatggatcgcttgagccctggtgt

SEQ ID NO: 44422 - DNA, 678 bp, Homo sapiens
gttgactgcagggaaaaatacactgttcgcaccagaaaacaccaaaactgacactgtggctgttgggcagcttcgggttcctgctgttgtatcaggggcagagagagaggcagagcttggtgtctgcagatccgggcccttggggccaccagcccctaaggcttggcctgtagcatcttccatactcactgtgttgcccagacccaggcctgtggggccacctgcccatgaccgccacagatggcgccgcttctgagccacagccttgatcacctgtgggtgcggttctccttgttctgccacaaaggcaaaatgggacgctgtcacccctgagacaagggaagctggccaggtagattaggagacctcggaccctgtggggtggaaaaaatggcaaagttttacaggcaaagcagtgaccacagcactacccaggcctaggactggggtaggatcagggctgccgggtccatagccagtccccttcccaggactcggtgccacagtggggttctcattaactcagaattccccaaagtggagacattcagcggctctcctttttgctagatattcacatcttttactcactaccttttttttcatgttatttctaccagtttatttgctttttgtattttaaggaaatagaaataattgcagccaggcccggtggct

SEQ ID NO: 44423 - DNA, 448 bp, Homo sapiens
cctttcgctcctgccctctgcccggccctactgagattcccaaggagaaggccgagagggggcgctccaggtctggagcaggtataattggagcatttgcactgagacccctgccagagaggagaaaaccctttcaagggaaattttaatctaaaaggaaaaaaccaaaatattgatgagaaggagtcctccagttagtgaaaggggagtttcgttttcagctttctttggttcctactccaattccacatccttcatcctggccatgcccccaccttcaagagcatgaagcactcttgggagttgtgggtcctgcccagagtccagagagcagcctcagctgagcacaggtccgagggggcgggggcagggccaagagttcaaaagaagccaatggagggagagggagcgtcagaagcccggaggagctggtggtgggagaatgacg

SEQ ID NO: 44424 - DNA, 399 bp, Homo sapiens
tagtagatctgaccatggaaagactgtagtctacaaagagaggtaattgcatctttacttctccagagaaaatttagtgatttgaaaaagcaaagatggctgccctcaaattaatccctgatggaccaatggtaagttgagcttgggaatttctcccaacctgacatttaaaaatgtctatctactagcaagtagctattgaggctttatagaaactccctaaattgcctcttttccctcctattatcaaattctcagcaaattacatgatcattttcatagcttccaaatgacgtgtctatatggttgtgagaccaaatttgtccttaagaccaaagctactgataaccattagggatcctgatagatattgataggccaaatccccattttgttcca

SEQ ID NO: 44425 - DNA, 313 bp, Homo sapiens
agaaacaactcaaatgtttaataggagtcagttgaacaaagtgtaacaaacctatcaaacgatgtattttgtagctacaaaagtaagtaaagacattctctaaaccaatagagaataactccaagatacttgagtgaacaaaaggaagttccagaacactacatatttttcataagacaagacacacagaattacacatagatatgcatacatatttgttatattaacagaaataatgggggccaggcacggtggctcacgcctgtaatcccagcactttgggaggccgaggcgggcagatcatctgaggtcg

SEQ ID NO: 44426 - DNA, 324 bp, Homo sapiens
ctacatacatttaaaagacaaaatgattgtatgcaaaactttacaccaatgagtttgaaaaaggtagatagaaattgactaaggtccagaaagcctcaattataaaattaacacaagaaacatagaacctctgaatagtactaaatctatgagagaaaatttatcaacaattaaacatttttttctacaggaaaagaaattcaggcctaaatgctttcaccagtaaatttactaaaattttaagatagaaatgataccaaattattctctatttcttttatgcaaaaacataacttgatatcaaatctgacaagtacattacaa

SEQ ID NO: 44427 - DNA, 481 bp, Homo sapiens
caggttcttgccaatttgttctctctctgatcaagtaagctgcaaacagtatattttgaacctatttttttggtattcattgtagtataaatggttataatgattttcaagtgtgttcttcctatctaaacaatatgcattaatttgaaacaatgaaattgccatttttctaagtcagaaatgttcaaacatctgccatttcttatagttcaacataatacagtaagaaaggattaaccaggcaataaagaaagaggttcaggagatttgggagatattcccaggggatatccccagaggctgaatggtcctggagaaatcataagcatccttgtgcttgttttcttattttcactgtgaggctaatgaaataaaataaaatggccaattaaaatttgatagtgttttgatagtgttgttgttgtttgaggtggagtgtcgctctgtcacccaggcttaactacagtgagacaatctcagc

SEQ ID NO: 44428 - DNA, 276 bp, Homo sapiens
caagggatcctagtactttgaagattgtgaaccactgtctgtgctcttaggcctagagaattcgtaattccttagctttgtagagatgtgtatcactatctgtgaatgctcttatttccaacaccctttgtaatttgacaatatttgtgttctgacatatgttgtatgtgatatttcagtctaaagaaatgtagtttgaaaagatctttctctgcatctcctttgttttttatcatttttaatggcccaagtaccaaagtagtatattcagtaaga

SEQ ID NO: 44429 - DNA, 721 bp, Homo sapiens
gaacgatcttaaccccccaatttcatcaccctcaccgcaacctccgcctcccaggttcaagtgattctcctgcctccacctccctagtagctgggattacaggcatgtgccaccacagcacggggccttaattatacatttgaacttaagtgacattttattgaaaactaattgtggtgacgaggaatggtctaagcatatgattaggataattcatattcattatgaaaacttaggtgaaatacagacttggcatttagcttgtcaaatgtaaacatgttttctgctttctttgctaaaatcatatttccaatttcaagggaaaatgttaagaaccaaaatcatctttttcagctacccgcctgaaaaaattattgctatttttcttttcttttttttgagagtctcgctctgttgcccaggctggagtgcagtggtacgatcttggctcactgcagccttgcctcccaggttcaagcgattctcttgcctcagcctcccgggtagctgggattacaggcgtgagccactgcgccaggccttcacagtcatctttagtatgtataacatttcatcctgtggtgtattattacttgtttttttttcgttacattaactgttttgatgatacagcatctcattgtttcttgataaagtatttccttctttttggataaattacctgaagtggaaatatatgtgtagggcattaaaaaaaaaa

SEQ ID NO: 44430 - DNA, 497 bp, Homo sapiens
ccgggaatgcgggaaaggggtggctgtcaaacagtcttgacaagcggctgaatgtgactgtgtcggatttggaaagtgcagcctgagaatttgaaatccattcactccccacccccaagcgttttttcatgtattcgttcattcagcacaccttgaatgaacactcttttatttgctacctattcagggacactacacaggcccgtgaccatcacacgcccagcctggccccgtggtgtgcctgagcagaggactgttggcagatggttcacttccaccctccatgataaatgctgagaaaagaaagatcaagggcttcagagcccactggagggaattcatacagccgggggcccaggaagctgctaaggaaactgcctggacggcagggtggccgtgaccacggggacggggagaaggacccagaggagctgaggaatccttgctgtggaaggcaccatatgagctgcgtgaagtcagagtcaaaagcaaacccg

SEQ ID NO: 44431 - DNA, 415 bp, Homo sapiens
aagtggatggacacacacacagcgtgacccaccagccggaccactgctcactttcagggctcaccaacctcagcatttccagccaaggccctgtggtgctctacaccatctccttgcctgctgccctgccccctggccttgacctgtctgaagatgagaccacctttcctgctctctgggagcccctggtcctgtgcagggtggcctagtagatattagaaattcaaaatcaaaactcagtgactgctgcagagggtgggcctttcccataaactgttcaccttcacagtggtgagcaagctgaggctcagaggtgttaaacagcgtgcccagagttacacagcttgaaagtggcagtgtcaggttgtgaacctggagccaggctatgaatctagagtgaagcccttggttatcc

SEQ ID NO: 44432 - DNA, 1329 bp, Homo sapiens
ccttgttacaaagcgtcaaagaacttagctgaactgtgtcctagtgttttgtggagccatgaagttggatacctacgtaaggagagttcaaagcagtgttgaaaggagcagttggcttctcctgtttctagtaaaatgtgaaaggagagagatggattgaagaagggattgttaagcaagagaaggaaccagaacttgaagatttggaaaattttcagcctggattatccatattgtaaaacatgagaaagcatattctgaagagaacaccaaaagtgtggggctggactgtccctcagtaaagagcttttggcattatgtgagtagaaacactgccagtttgaattgaagtggttggagacaggaagtaatgaaggccgacagttgaacttcttggatttgacaggatgtaatgatagaactgttcagctacaaaagtgcagtattcttcaagaaaaggggaaaattatgccaaaggtgatttaagggtcttgagggctaccacctgtttcaacaagtcagctagcctctacccaaagcctcgggagcagaactgaacttcagagccacagaagcaggaccctcacctagagcactggcggtgacctgccaccccagtggcctggtgggcagagtatggaaccaaacagaattattctcaagctctaagatctaatggaatttgccttgctaggttttgacttccttgggatcatcaccctttttttcctgtttctcctattggagtggggatgtctcttctatacctgccctacccttagattttggaagcacgtaactcatctggtttcacagattcacagctggagaggaattttgcctcaggatggattgtacctaggtctcatccatatctgatttagatgagactttgaattttagccatcagagttaatgctagaatgagtgaagactttgggggatatggggatggaatgaatgtcttttgcatttgaatttggaaaggacatgagttttgaggggccagggatggaatgttatagactaattgtgttccctcaaaaatgtttatgttgaagccctaacccccaatgtgttggtatttggagatgggcctctgggaggtagtttatgaaggtgagaccctagtctgataggattagtgcccttaggagagatgccaaagagcttgatgtctctctttttgctacaaaaagacacagcaaaaaggcagccatgtgtaagccaggaagagagtcttcaccagaacctgactatactggcagcctgatcttgtacttgtagcccccagaactgttagaaaataaatttctgttgtttaagcca

SEQ ID NO: 44433 - DNA, 324 bp, Homo sapiens
  misc_feature (2)..(2): n is a, c, g, or t
tncccaggctggagtagtggctcgatctctgctcactgcaaccttcaccttccagggtcaagcgattcccatgcctcagcctcccaagtagctttgagtgttctagttatgctcggttgattaattaaaaactagactcaactggtgactgaaaccaaataggattgggttggcaataattttttttttttttttcttgagacagtctcactttgtcacccaggctggcgtgcaggggctggtctcagcttactgcaacctctgcctcttgggtttgagtgattctcctgcctcgcctcccaagcagctgggattataggcatg

SEQ ID NO: 44434 - DNA, 423 bp, Homo sapiens
ctactcgacctctgcatgctccagccttctcatctggagcggcagtgccgatcttgtaggcttatgattagaatgggtgcacctaaagctttcaacatcgtgccagtcacaaagtgagcattcagtaaaagtcagccaccactactatcattaatgaaactgcactcattacaggcttcttgtagccaacaacaggcttaataaaacagaagaattatgaggtaataggaccaaagcatgccacaaagatccctggagaaaatagatcacgtgtgaccatatcacaatatttccacagcagaaggggcctgaacttggattcttgctttggctccgtccactctgcgctcttgaaaaagtcactagagagttccctgaatcagctgtttcatctgaaaaggaagatactatctctcccatctc

SEQ ID NO: 44435 - DNA, 411 bp, Homo sapiens
tttcgaaaattttaaaataatgaatgctgccgtcgcttgtttgcaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagttaaacgttcttcctaca

SEQ ID NO: 44436 - DNA, 650 bp, Homo sapiens
tctcaaattactggaaaactagttgaagaaataaacaggcagtttgtgaatattagatagaacagtggtgctgagcatggctaaagcatctctgcattcacagggagaggagcggaagaccttctggtgtgggctgggcagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagagctcccgccgcccctggacttcgtgctccctccccccgcggtcgccaagaggcctcctaatgccccacccccgcaagagacacgaagcatcaatgttcagaagcagcaaataaataaaataaatgaataaaagttaaacgttcttcctaca

SEQ ID NO: 44437 - DNA, 744 bp, Homo sapiens
gtcagccatatgcctgtgctctcaagtgccaagtttgtggggatgcatgcaggggattctggacctgattgtttcctctgaaccaggatgtggtctggttggcagggcaactggtcttcacttggtggccttcagtgggtgtcctcattggttgccttcagatagtgccctcagttggtaccatcagttggcgctcttcaggtggtggtcctcagttggtggtcttcagttgtagggcaatggtggaaggaggatgaaactgtgctttctcctcccccagtcacagctctcaggcttgctgcctccgggcccttctaaaataaaccagacaggttggcaggtttttcttaacagacaagtcagctcagggtacaggggtgacacagggtgcaggctgctagcgcagtgccaccccatggcccaggggtgcccgtgccagccatgcctttgccaggaagaggcgataggtgttgagctctgcagacttggggacaagcgaacacccaagctgcctgagaagtgcaggggtgccccatggggaccacactgaactgtcgcatgtgcaccaaagccagccccagtcagggccggcacaaggtttctgcagagccagcctgtggctctgacgtctacaagtgtgcatacaacgaaggcgcaggctgcgatatacaggagcagaggcacccagaacacgctgcccctgctgccagttgcaagtggggtctgctcagaatgcggagggtg

SEQ ID NO: 44438 - DNA, 376 bp, Homo sapiens
ttctgaaagcagctgcagaaatttgtctttttttagtttgcaaaaatttcagaggttatgggggaaagtggggttctatgaatcccagatagtacatgaagcagatttggtttcagtaattttagcataattcattgtaaggtgatgatccctaggaacttcatcacagtgagcaacctgaaagctcccactgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagttaaacgttcttcctaca

SEQ ID NO: 44439 - DNA, 709 bp, Homo sapiens
gtcagccatatgcctgtgctctcaagtgccaagtttgtggggatgcatgcaggggattctggacctgattgtttcctctgaaccaggatgtggtctggttggcagggcaactggtcttcacttggtggccttcagtgggtgtcctcattggttgccttcagatagtgccctcagttggtaccatcagttggcgctcttcaggtggtggtcctcagttggtggtcttcagttgtagggcaatggtggaaggaggatgaaactgtgctttctcctcccccagtcacagctctcaggcttgctgcctccgggcccttctaaaataaaccagacaggttggcaggtttttcttaacagacaagtcagctcagggtacaggggtgacacagggtgcaggctgctagcgcagtgccaccccatggcccagggcaactggctttcacttggtggccttcagtgggtgtcctcattggttgcctttggttagtgccctcagttggtaccctcagttgtttctcttcagttggtggtcctcagttggtggttttcagttgttgggcagcggtggaaggaggatgaatctgtgctctctccccccgcggtcgccaagaggcctcctaatgccccacccccgcaagagacacgaagcatcaatgttcagaagcagcaaataaataaaataaatgaataaaagttaaacgttcttcctaca

SEQ ID NO: 44440 - DNA, 775 bp, Homo sapiens
tctcaaattactggaaaactagttgaagaaataaacaggcagtttgtgaatattagatagaacagtggtgctgagcatggctaaagcatctctgcattcacagggagaggagcggaagaccttctggtgtgggctgggcagcaattcacttgaaggagaaacagccccggtgtggagaggcggccatccttggcgggatcctttctaaggagccgagaaatcaacgtagagcttcctctgtctgattctctaacaactgcagaccttccatgagtcaagctttgtgtcaaaaggacaaataaaaaggacctataaaaggcatcaccaagcccaatggacagatgccccaggctgcacattctgtcagtgctgttctggaaaaggcccaaacacatgctgaaacatcgaaggataagaagccagccctcgggaaccggcaggagcactctgggccccgcacggccccaagtccagcctgccccgcctcctctggtgcagaggtccagggataccagcagcagccccgccacgcccctccaaggccaagaacacaggcggcaggggcttcccctccctgccagactacttcctgccgccacagccaccacccttggacgacccagagctcccgccgcccctggacttcgtgctccctccccccgcggtcgccaagaggcctcctaatgccccacccccgcaagagacacgaagcatcaatgttcagaagcagcaaataaataaaataaatgaataaaagttaaacgttcttcctaca

SEQ ID NO: 44441 - DNA, 1070 bp, Homo sapiens
aagaaggcattcagggcaagccgactcagcccggagccaggcccttcatctttcctgccttcctcccatctaccacctggaagatagatgccatggctccagtagctgtgcttcaccatgagggccttgggatggaggccagtgcctaggacagccatgggacaccacaccagcaactaactgaccacctcccacatcttccacatgagtaataaaacttggtttactggttaattattggtaaattattttcaggttaagtattaacaagtgtcattacaaatatacagcacagacaggtgcagtggctcacacctgtaattccagcactttggatgccaaggtgggaggactgcttaaagctaggagttcaagaccagcctgggcaacataacaagatcccatctctacaaaaaaataaaattagccaggtatggtgatagacacctgtggtcccagctacttgggaggctgaggcgggaggattgttctagcccagggattctaggctacaaagagctatgtcacgccaatgcactctagcctgggcaacagagcgagactctatcccccctccaccacaaaaatatatctctacagttccttaggtctgaaggaacacaagttctcttcaagtgatccatgatcaaaaggatcatggctttctttaggtcacatgacacagcctcagccagtacagaggccaaggcatggggaatactccctggcgggaaggctggagcagatgcttccgtagttaaaacaggccccgagagaagtgcagctggttgccttggagcgaggacacattcttctgcaactccagtgctcatttcagcatgagcactggctcaaggaggagctgaggaggacgatggcgtgcagtgaacgttaatagagcatgcactgtttggatgcaggtgcccagcacagggacatgaaggaagtgctccaagtgaggaggtgctcaaaagggagcccctgctgtgagactgctcctgggccccaaaccctctccactcccctctccaccatgccctatccaaacctggggctaatccagccaccca

SEQ ID NO: 44442 - DNA, 415 bp, Homo sapiens
aagaaggcattcagggcaagccgactcagcccggagccaggcccttcatctttcctgccttcctcccatctaccacctggaagatagatgccatggctccagtagctgtgcttcaccatgagggccttgggatggaggccagtgcctaggacagccatgggacaccacaccagcaactaactgaccacctcccacatcttccacatgagtaataaaacttggtttactggttaattattggtaaattattttcaggttaagtattaacaagtgtcattacaaatatacagcacagacaggtgcagtggtagtttcttaagggttagttgccacaggaattgggaagccttaacaatggttttttttctaatgtgttaacattaggaagtcattggtgtaaccttgcatttggaat

SEQ ID NO: 44443 - DNA, 342 bp, Homo sapiens
atatatatatatatatatatatatatatatatatatacccaacatcagagcacttaaatatataaagcaaacattaatagagctaatggaatatattggaatacagtaatagtagggaatttcacctcactttcaacaatggacagatcatccagacagaaaattaacatagaaaaactgaatttaaactgtactctatacccaatggacctaacagacatttatagaacattctgtccaacagcttcagaattcacattcttctcaactgcatatgaaacattctccagaatagatcatatcttaggctacaaaataaggcttaacaaattcaaaaaaagt

SEQ ID NO: 44444 - DNA, 441 bp, Homo sapiens
ctggctaaatgttcatcagaggaaaaaaacaatgaacaaatctataaattctccaaagttgaaggctaataaatcctaaaagatgaaagaatcttagaactagaaagacggctaggcattatttaattcaatcatttcattttagagattaaaaagactgaggactaaacagcttaaaatgacttgcttagccacaaaaggaaatgagcagcactagatccggggctcctgcctcaagctccaaagctctctccactagagtgcagcgcttcccctactgtactagtttaaatctcacctttcgctttgatcaaagtcatctctatggttactatctggcaacaaaatgaagggcaaaaatagttaaaatgcaaaatactatttaatgacagtcacccatcacatttgcaattactattagtcacgtgactgtgatcaata

SEQ ID NO: 44445 - DNA, 192 bp, Homo sapiens
aaaaaaaagaaagaaaatgtcagcacttatgttagaaaaaaataaaagaccaggggaactggtatgagatgaaaaaccaactactctttaataaaccaaataataataataataatatatgatagttagatcccatctaatgggtcccatcaggaggtcttaaaccgccacctagtgtccaataccaaaagc

SEQ ID NO: 44446 - DNA, 1931 bp, Homo sapiens
aaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaaaaaaaaaaa

SEQ ID NO: 44447 - DNA, 1158 bp, Homo sapiens
aaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaaacaagatctcggcttgcttcctgatggccatccctacccaacagagtgtgggggatgggggtgggggtgctgcagagaaaagactaaagaagaaacctaatgtaggttccattcttaaccatattctttgctcctctctgctccaataccaccaccttgtccactcccaaaaaagtaatcgggtgtgtgtgtgtgtgtgagagagagtgtgtgtgagatatgaatgcatgtatttgtatgcttgcaggagatggcatattattgagccaaacccttctctggccctcaccttcagggaggatgagtggaaaatagcctcctcttgcccaaacatgaagggtgcttgaggtctcagcaggagctgaagaacacaatttggggaacagaagggcttttgttttggagggtttttttttttaagatgaattcaacagcctggtggttaggatgtttctaacccaagccagggcttgtgaacatgaattttctaaggtgaaataaaccttttctttctgctaaaaaaaaaaaa

SEQ ID NO: 44448 - DNA, 820 bp, Homo sapiens
ctctaccatgtaacctggagctttccctagatgctttgatctctgatagccagtgagtgagtcccccagatttcatccagagactaccttggtagttgatctcctgccttgctggaacagtaatggtacaggttggggagcatgagatcccagatcccgaggcatgggagcaggcaggctccagctcaagtcatactcagactgctgggtttgacaggatagacagcttacccactccacctccttccccaaagggtctcttacctccatggagtacaggagatggcagcacctttagacagcatcagagaggttcctttctccaacagctggaagtggacccagagtagaacagtgtctccaggaagagggcagtggtggcctcatgacatgcctgattattgcccccaggtggtggtagtggaacaaaatggttcttttcaagtaaagattcccaaaaattttgtttgtgaacactgctttggagcctttcggagcagttaccacctaaagaggcacatccttattcacactggtaagtctcttgtttatattcaaaagggggagaatagtctatcgcttgtattccatgtctgtttgtggctctagttgggtttattttaatgggtaagtattagaaatgaaggaagaagataagtcaatgaagcagagagattgcatggctttgtatctggtgtcactgagaccagcacctttggggacctctccccatttatgatcacttaggtgtctacacattactaagagttaaagtttctgagaaaactggaatgaggtccctactgtacatacctcccca

SEQ ID NO: 44449 - DNA, 323 bp, Homo sapiens
aaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcaggtaaggctcatccctgctacaataccccacacacacttttccttccccaagaatcagggccaccctccactcctgcctgacaaaagagccaccagcgttactcgccataatagttaacacatcgggg

SEQ ID NO: 44450 - DNA, 1455 bp, Homo sapiens
aaattttgtttgtgaacactgctttggagcctttcggagcagttaccacctaaagaggcacatccttattcacactggtgagaagccatttgaatgcgatatatgtgatatgcgtttcatccagaagtaccacctggaacgccacaagcgtgtgcacagtggtgaaaagccttaccagtgtgaacggtgtcatcagtgtttttctcggacagatcgattactcagacacaaacggatgtgccaagggtgccagtccaagacttccgacgggcagttttctctataggcgcaaggggccccgggtggtgggagtgatcagaagaacctgccgaagagcacaccccctctggtctgatggtcccaccaccgccccatgtgaacctgtcccactcctggaggagtggacccaggagaccagaagagtgcatcaggggacagtggccccagaacctcagctctgtaaataatctgagactatgagtatctcggggaagttcttacagcattcctgggtaggggagctagtccctggacccttggctgaggtcataggtggggactcaaggtacaggaccaagactgaagtgtggctcccacaaccttggactccagctggcagctgaaatggaaaagattggggaaggggatttgtttgttctgttcttgtttttgtttatccaaaagcaacttcagcgggtaaactgtggatacaggtaatccagaggcataagagtcctggtccaaagtagggactatagctggtccagctctccccaaaaattgggtttttagttgcagtagctcctcagtgtttcacaatcctgcacttcgcctcctttttgaggaagaataaggtcaggaatggcagctgagcttactttggcttccttatacactgtagggacaaaaggaaaaacggggtggagcagacaagggctggatccaaaaagtggatggcacctcttccttcctcaagggaaaaggaagagttgtgccagtgggtgttgtcatggcccatgtcacattggcacctgatggcatcagctcaaatgcctttaggaggaaacttgggtgagagtggcccatgaagcccttttcttctttttttggggagtcggtcttggagatggtatgtggctacctcgctgccattgactcctaaagtgagacagatgtgttgagcaaggagtcatggaagtcaaagtgggttctctctccttgtgccctcttaggaacaacccaagactggtcccaagttggctaacagctgctcaagaaacaaaggaatctggggtcttctgacatgcctgttgagcagtaggagctgttctccctccccaagtcctatcactgtattcaggtagaggaggtagggaggggtctgtcctttggtcccaaaaaaacaagatctcggcttgcttcctttattggacgttttttccaaaaatacatgtt

SEQ ID NO: 44451 - DNA, 1800 bp, Homo sapiens
gcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgactcatccatccacctatgagatcagacagggagggatccttttttgtattggtctgtataccacagcatggcttacgaagtgggtatctatctatcacccatccacccacccatttatctacccacccattcatccacccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcacccatttacccatccatccatccatccttccaaccatttatccacccatccaaacatttccatctgtttttccatccatctacccatccacccattcactcatccatccaccttcctatccatttatcatccatctacccactcacccatccatccaaccttccaaccatttatccacccatccaactatttccatctgttcattttccacccatttacccatctactaattcactcatccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccacccactcatccatccattcatccatccacccacccacccgtccatccacctacctattcatttatcacccatccatccacacacgggtctgtgcagattcattaatatccacccatgcatccatatttatctattttctatccatcagccatccattcattcatatccatccatccatctatccatccagatgtttattgagcacctgtgttctgggtcctatttgggagccttgttaaccaccaagaccttcctaagccatattgtggtatacagacagatacaaaaaaaaaggctctctccctgtctgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaatgaaatatgcagtgtgtcagtgctggtaaacccgtggagaaaataaagcaaggttggggtctggggttggga

SEQ ID NO: 44452 - DNA, 2155 bp, Homo sapiens
gcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgactcatccatccacctatgagatcagacagggagggatccttttttgtattggtctgtataccacagcatggcttacgaagtgggtatctatctatcacccatccacccacccatttatctacccacccattcatccacccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcacccatttacccatccatccatccatccttccaaccatttatccacccatccaaacatttccatctgtttttccatccatctacccatccacccattcactcatccatccaccttcctatccatttatcatccatctacccactcacccatccatccaaccttccaaccatttatccacccatccaactatttccatctgttcattttccacccatttacccatctactaattcactcatccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccacccactcatccatccattcatccatccacccacccacccgtccatccacctacctattcatttatcacccatccatccacacacgggtctgtgcagattcattaatatccacccatgcatccatatttatctattttctatccatcagccatccattcattcatatccatccatccatctatccatccagatgtttattgagcacctgtgttctgggtcctatttgggagccttgttaaccaccaagaccttcctaagccatattgtggtatacagacagatacaaaaaaaaaggctctctccctgtctgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaatgaaatatgcagtgtgtcagtgctggtaaacccgtggagaaaataaagcaaggttggggtctggggttgggacaaaaaaaaaaaaaaaaaaaaaaaaaaaaaatttttgggcggcttggccctgaaaaaatttttaaaacaattgtggtgggggagcgcgggcccccacagtcgggatcgatgaaccacgtaggcacataaaggactggggactccaccaaagaagaaaaacaccgtggggccatacggaacaaagagggggctggggagattacctacccgcaagtttaaacaaaaccgccggggggcaaacacacacggcgttctggaaacacaacccacagagtgagacatcgtggagagaccaaacacgggggtcttacaacaaaggggggccccagggcgcgcccagataaaatagccgccg

SEQ ID NO: 44453 - DNA, 1199 bp, Homo sapiens
atggtcgcgctgggctcgttatgaggtcggcaagcatcccaccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccacccactcatccatccattcatccatccacccacccacccgtccatccacctacctattcatttatcacccatccatccacacacgggtctgtgcagattcattaatatccacccatgcatccatatttatctattttctatccatcagccatccattcattcatatccatccatccatctatccatccagatgtttattgagcacctgtgttctgggtcctatttgggagccttgttaaccaccaagaccttcctaagccatattgtggtatacagacagatacaaaaaaaaaggctctctccctgtctgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaatgaaatatgcagtgtgtcagtgctggtaaacccgtggagaaaataaagcaaggttggggtctggggttggga

SEQ ID NO: 44454 - DNA, 1826 bp, Homo sapiens
gcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgactcatccatccacctatgagatcagacagggagggatccttttttgtattggtctgtataccacagcatggcttacgaagtgggtatctatctatcacccatccacccacccatttatctacccacccattcatccacccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcacccatttacccatccatccatccatccttccaaccatttatccacccatccaaacatttccatctgtttttccatccatctacccatccacccattcactcatccatccaccttcctatccatttatcatccatctacccactcacccatccatccaaccttccaaccatttatccacccatccaactatttccatctgttcattttccacccatttacccatctactaattcactcatccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccacccactcatccatccattcatccatccacccacccacccgtccatccacctacctattcatttatcacccatccatccacacacgggtctgtgcagattcattaatatccacccatgcatccatatttatctattttctatccatcagccatccattcattcatatccatccatccatctatccatccagatgtttattgagcacctgtgttctgggtcctatttgggagccttgttaaccaccaagaccttcctaagccatattgtggtatacagacagatacaaaaaaaaaggctctctccctgtctgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaaggagatgaaaaaggaggaaaaaaactcaagggggggccccgtacccaaaattgccccaataggggttgaattacaaataaatgggccgtcggttatac

SEQ ID NO: 44455 - DNA, 689 bp, Homo sapiens
gcttcccaagtagctggggttacaggcatgagccaccatgcctggctaattttgtatttttagtagagacagggtttcaccatgttggccaggctggtctcgaactcctggcctcaagtgatccgcccgtcttggcctcccaaagtgcttggattacagatgtgagcccccgcacctggcctcatttgtccattttccatccacttacccacccacccatttactcatccagccattgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaatgaaatatgcagtgtgtcagtgctggtaaacccgtggagaaaataaagcaaggttggggtctggggttggga

SEQ ID NO: 44456 - DNA, 1048 bp, Homo sapiens
ctggacgaggcgcgggtcaaaatcggcagaggctcaaccatttatccacccatccaactatttccatctgttcattttccacccatttacccatctactaattcactcatccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccacccactcatccatccattcatccatccacccacccacccgtccatccacctacctattcatttatcacccatccatccacacacgggtctgtgcagattcattaatatccacccatgcatccatatttatctattttctatccatcagccatccattcattcatatccatccatccatctatccatccagatgtttattgagcacctgtgttctgggtcctatttgggagccttgttaaccaccaagaccttcctaagccatattgtggtatacagacagatacaaaaaaaaaggctctctccctgtctgatctcatgcagcctgccttggagacaagactctcccagtgctgtgtgcttggagagaggaaagcacacagccctggagtcagagacctgggtttcaattctgtctccacctcttattagctagctatggactcctctctgagcctcgattacctcatctgtgaaatggggtaatggtgtgagcagcgtttccctgggggatgtgatgcagcccacttggggcctcatgcactcagcatctctttattagcaaacacttattgaacccctagtacatgccaggcactgttatgaggtcccggggatactttataacaaaagggacagaagcattcctgctcttgtgaagtttacattgactagatagtaaacaaaataaatgaaatatgcagtgtgtcagtgctggtaaacccgtggagaaaataaagcaaggttggggtctggggttggga

SEQ ID NO: 44457 - DNA, 473 bp, Homo sapiens
atggtcgcgctgggctcgttatgaggtcggcaagcatcccaccacccatccaactacctatccattcatccatccacccatctgccaacgcatccatccatccacccacccaatcatctacccactcacctatccacccatccacctacctatttgtcacccatccacccatccatccatccaatcacccatccaaccatcaatccaaccattttcatctgttcattttccatccatctacccgtccacccattcactcctccatccacctacctatccatttatcatccatctacccactcacccatccatccatccttccaaccatttatccacccatccaaccatttccatctgttcatttccatccatctacccatctacccattcactcatccgtccacctatccatttatcacccatctacccatccatccaccccacgaagggggatgacactaaatcctctagag

SEQ ID NO: 44458 - DNA, 561 bp, Homo sapiens
caatacatttatatatttcaggaaaataatgaagcttttctggaagacaaattcaagcactagattaaggctgcatgtgtagttttcctccaatatttgaggttttggggtgctattcatttcccttcctccgctcagagtttgaaccaattgagaatagatgctaggagccagatggggatgaagaaatcagcctttatcctagtaaacctggaaaggaaaatgctgcaggtctcctctctcacaccttggaattcaacttaaccacccagtaacaagcagagaaaccagggaaaggcagaggagagcacctcactccgcttagccccacacagatcccagagagagtctagcttaggatggagtgcagtggcctcacctactggtagtgtggcccaatagaagcctgccagttcccatcccaccaatcagatcagtcactcattccatggagtggagtaatcagaagtgttcaacacttggggaggcagaggcaggaagatcacttgaagtcaggagctcaagatccacctggacaacaaagggagaccctgtctctac

SEQ ID NO: 44459 - DNA, 439 bp, Homo sapiens
tgagacagagttttgctcttgttgcccaggctggagtgcaatggcgcaatctcggctcaccacaacctccacctcccggcttcaagcgattctcctgcctcagcctcctgagtagctgggattacaggcatgtgccaccacacctggcctaattttgtatttttttaagtagagacagggtttctgcatgttggtcaggttggtctcgaactccctacctcggcctcccaaagtgctgggattacaggcatgagccacggcgcccggccatgtatattttttaaagcagtattactcattcaattgaaaaaattaattctacagctcaggcttttttgaagtcatatttcatactacaagttctatacagaagcactgtttaagctcttaaatattggttacatttcagaatttcagtcctcagacccagaagacattt

SEQ ID NO: 44460 - DNA, 429 bp, Homo sapiens
caaaataataggctatgcaagtaatcaatatattgcctctcaattccaaatctacctttcattgccctgcctgtaataatgtaaacatttcttcctagagagcgggcatgatgacactaagcttagtagagggcatggaaggaaagggtttctcttcctggttatagtgtgcttttgcatcttcttacttccatggtgctctgctggtgtgcagaaccccccatggtgctcatcccgacaagcttttaagggggggcgggtcaaggacatcttcccaggcaagttccaccagtgcctcaaacaggcttgctggtgatgccgcagcacccccaagtacagcttcctgcttaactacctttgaggtagaagaccagcaggacttaatttcctgtcgcaccctgctgattggaacaagatctggctgaaacc

SEQ ID NO: 44461 - DNA, 2090 bp, Homo sapiens
ggggatctggcatatatgacattatatagaggccataatctaacactttaaatatcaaagctatcttttctcggtttctgcttttatccatgttttacgtactttctttgtcctcttctgatacttttagcttatttgataaccctggttgagaaccaaagcatcatgaatcacaagattctctacatattaacattttgttagaagctcaaagcacaagtctttcattaactgttgatcattatattatttttgccagaatatactggtgccttgtacacttgagttttaatagcattacagatatcattttagtgtacatatgtcaaaaccaaaactgcctttatgtcaatatgctgcaaaaatctatcagaatatatcttaattcttaactttcattgttgtctgtgggttgtcttttataattattatcacatccacagtattttctggaggtaaatatgaaatgtattataaacgtactgggggaaaatgctctttaaagcgtttccctagacaaagcaccatttaggtgttagaagcaagaactagtgaaatcagaaattgctgtcatacatactcaccagtgaacgggcgtacagaggatccccaagcgcaggacttgtcctggaagcagaggattggattccatcaggaaaagaggcaagtagaaacaccaaatgctggtgctccctttccccagctcatcttatttgcaggcacacagattttggaatcctccaggactaacaataaaaaccacactaggttgttttcctaattcctatgaaatgagtcagtaggtcaaacaacttatccactccagagagagaacaattccttgagctacactccctgtttccagtaaccctattccctgtctgtgcccctggataaaagtgctgccaataatgcatggagagcccaccgggttctgaattagacacatcatagagattgccagaaagttagttgccttcatgggatagtttcccttatgaatatttaggaggaaaaaagtccagttaagagtaacatgaggatcaagtttcttcatttaaagagtcagcataactttttctctatcgagaccatttctttctttcatataggaggactgaatgatgctgaaaataaatatagaaaagcgataactgtacctttaaaagcccccacaaaccacttccttctgtaaaacaccctttcctcctccaaaggtctagtatattcacaagattcactgattattcaatgaatccatattcttaaaaacccttcacagttgtctgtgcgtcctgcagttccatactctgtatcatataaagcagaaggtgtttaagagcttgctagccgtcatttaaatccatgactcaagacgaccaacactgggttaccaataatcttcagaaagtaccacctactcaccgagtgtaacatttcttgtagttagcgacctctgcttaggaaatcaccagctcctggcaatgaatccatacttccaagaactcacacattcaggcaaatatatggacatacagctctaaatatagatacagagaggtctgccgtgacagttcagtaggagactggaaatacttttgctttctgtatcgatagtactttctttcctttttaaagagaaggtttcgttttgatcttgagaaattctgataaaaccaccaactgaaaacctgccattataaaggagggatttcacaacgttcattccaaaaaactgtggctattcatttctggaagtgattcactgcagaagaatcgctgtttgggggtggagggagcgttgatttttagaagccagcctgccctctgagaagtgagcagcaacctctgagatggcagccacgtgccttctgacccccagccctgctccctgaatcaccacccctcgagatgacacgcagtgaccaatttcctcttaaaactcccttctgttcaaaaaccctatgatccatgcaccctctgtctaatcctctgcgatggggccagtctgcagatccgtctgggcgggctgcggtagcattctccacctgccaacactcagttgctggtgagtaaccagcatacggact

SEQ ID NO: 44462 - DNA, 796 bp, Homo sapiens
tccccagtccactacaggcataccaaaagaaagtcttaaatttttgtatgatttctgctaaccctgctaacaagtaaaaaggaataccacgtagaaatcctattaaattatgtttacttaatttctgtatactatgacttaaacgtccaaatctagtgagagttaaaaatgtctcaacatttctaacaatgaggtgtttgtttactattaaatgtattctatttacagtaattcacaaataataattaaacaactacttataaaaataaaccacttgtaaaatcacgtaaaaatcatgtcatcatatgcttaagaagtcatgctccatctaacctaatgaagtttttaaaaacaaccttttctccatgaacttgagatattcttagactaaatttactaaagaaatgttaattccatatgttacacacacacacacagacacacacacaccttatagattaactcatacagataatgccaactaggtcaaatttcacttccagaaacacaactatacagccttccataagaagaattacagaaagaacccataaaataagtttccaaatatgatggtggttgatttggagtatcaacatgactggattaagggatacccagtgaaatggtttggctttgtgtccccacccaaatttcaccttgaattgtaatccccataatccccatgtgtcaagggcggggccaggtggaggtaattggatcatggcggaggtttcccccatgctgttgttgtgataatgagtgagtctcaggggatctgatggttttataagtg

SEQ ID NO: 44463 - DNA, 354 bp, Homo sapiens
ctagctagcaagccatgaggtagggatttgaatccatgcagtctgggtcttatctattatggtattatcactccaagtgatttgcaaactgtccttcttcaaactctgaggttctaaagaggtatgctctatgcgtgggaggagaggtgaggggaggccaggcagacatgcatgccaccctactgtcatcggagcagccctgcttttccacactgggtttcacaccgataaagagatcagaatccaagtccaaagccactgatctagttgaacctttccattttttcagttagactgaggggtgagggaaggggacttctctgagatcaggactaaatgcaggctctctctctt

SEQ ID NO: 44464 - DNA, 435 bp, Homo sapiens
ttcaacatggacttattgagatgtagccgcactggaccaatctggttcaacttttttttttttccttttttttttttcccaatctggttcaagttttatgtaacaaagttgtgagttgtttttcagttgccacggaccctcaggtcacataacctgagcgtgtccagatgaaccaggtgtgtaactatagggggaatctaattgctcagacccaagagcagggactcaattgagaagcagacactggctgggcacagtggttcatgcctgaactttgggaggccaaggcaagaggatcacttgagcccaagagtttgaaaccatcctggataacatagtgagacacccccctctacagtttatttttaaatttgctgggtgtggtggcatgcacctgtagtcctagctacttgggagactgaggtaggaggattg

SEQ ID NO: 44465 - DNA, 426 bp, Homo sapiens
atttttccacgtttgaagtagggtgcacatgatctgtctacagtgcagttctgcacagagacctgcagccactccaggacatgtcttctggaaaacacgaagtggctaagagagaaatgacctgtgaaagggatcaaatgtgcctctgttggggttacaataattcatacttatgagaaaagggtgaaatccatgaaaccagatcgtggctcctcagtgaagcatggagaagagcattaactcccagagaaaagatcacagggaaaggcggagtgaaaggctcatagcccatgtcccaggactggagagagcagctgcatcacagaaaaacaccagaagcttgcccgggagatgccgccctactgcagaagacacattccttcagcatgaacaacagcagcatcttgctgggataaaggagagagg

SEQ ID NO: 44466 - DNA, 513 bp, Homo sapiens
gaagaaagttttcaggctgtggcttatggaggagaaatccaggcagaatctggaggtttctttgagttgaggaaaccaagctgggaatttccagaagccaaggcagatggcattcattggacagagcaccataaaggtgaaagcagcacagagtcagctttggaggcttacagatggtcccccttcagtattcagttgagtgctgattagctcatgcatgtgaggaaactactaacagctggaggaaagaaccatctgaaaggattagagagagtcatactcagacttggcaggaccaagatcagcatccgttcctagcaagacttgagaaatgtgtaattcatggctcatagttagcatactaagaaatatcttgccttagtagtgggaaaaaataaatactagactgaatgcagtaccggcctacataacacagcttaaaaggatcaaattgtgttcaagtaacttgaagatatcccagaacaaatctcacaaatattgatagaaatattt

SEQ ID NO: 44467 - DNA, 347 bp, Homo sapiens
caggacaccggcacgagccgcaaggaaggatccagccccatgtgctcgcaatgccatggctaagaaaccttaatttaaaccacaccataatgatttcaaaggactgcttgtttgagttccattgtatggctttgtagaaaattaatttttttagtgcaaatgctatacatgctgatgataaaatattccagggcaaaagcaataacaataaaaagttaccacctctagctgggtgtggtggctcacgcctgtaatcccggcactttggaaggatgaagccggtagatcccttgagcccaggagttccagacctacctggcaacatggtgaaaccctgtctctactaa

SEQ ID NO: 44468 - DNA, 395 bp, Homo sapiens
cccctcgcaaaatgcctaggacataataggtgttctataaatgtttgttgaatgaatacagaaaaaccagagcgccactatgggtaggtgagtgggatggggaaggccctgaaatccagagcacagggggacctgggcatgtgtgtgtatgtgagggctgagtagggagattgttgtggacagaataatggtccgtagaataaaggtccacattctgatccctggaacctgagaacacgttatgttaaatgccagagggaattctggttgcagatggaatgaaggttgctcatcccgattgtaaggtcgagagattactatggattacccaggtgggtcagggtaatcacagggttcttacaagtgggaagcaggagagtcggagaagatgtgat

SEQ ID NO: 44469 - DNA, 387 bp, Homo sapiens
gccccaagaaaatgggcaattttctcagtcatgcaaactggtaagtggtgggactgagatatgaccctgcactcgagagtccataatcttcaccactatgctgcacagcctctcttgataagctattgttacactcttgaggaagcagtcatagaatcctatgactttttacaagcctttggaaaatcacttttcctgatacctagatatgtttcagcacagcactcccaaatttgatgttactttcaagctcagctagacgacttctgcaaaaggcaaaatagtaatgtattatcatggttggtttggttttctcgagaagtgtctgaaggttgaaagaaaattcaataaataggaccaaagcatctaccatatttcaataatgga

SEQ ID NO: 44470 - DNA, 419 bp, Homo sapiens
gaagaatttaatcttgcagccactccaacaatagccagaaagcacccctaaatgtctgctctgaagccttatttcaaggagacagcaagagaagaggaaagctttcttatttttaatcccagcatcaataaaatcacaggttgatgtgtatacatcacagggcagttgttttgaaaaagaaataaaagtaaatgatgaaactttggaaaaaatggactctctggaatggaaccaagaacaggctctcagtgttgaccttttggttaaagccacataatgcaatttatgtcatccctcaagatatatgattttattggtttgctgggaacttgggcttaagggaaattgtacattgggaaagtaaaatgtttagctcttattattgccaaatgaggtgttataataagaaaaaaaaaatg

SEQ ID NO: 44471 - DNA, 439 bp, Homo sapiens
gcccaggctggaatgcagtggtagaatctcactgcaacctccagccaagtcatctcacctcagcctcctgagtagctgggactactggcatgtgccaccacacctggctaatttttgtaatttttgtagagacggaggtttcatcatgttgcccaggctggtcccgaacttgtgggctctgccttggcttcccaaagtgctgggattacagatgtgagccattacgcccggccctacctctttcttttacacggctgcgtaatagtctacttcagggcttaccataaattatttataacagatcctctgtattgtttctgattgcagtgagctccttaaacaaatatctgtgctgtgttcatgcagtgatagctttgagtattttcagggcagtacaagctctgcccatttttaattaatgcatttgttcaacagatta

SEQ ID NO: 44472 - DNA, 218 bp, Homo sapiens
ttcattttcaagtcagacgtttggctgctgctctgtcccctgcaacaaggagccatgccagctggacacacacttcttccagggcctctggcagccaggacagagttgagaccacagctgttgagaccctgagccctgagtctgtattgctcaagaagggccttccccagcaatgacctcctcattgcttctggcctttctcctcctggctccaacca

SEQ ID NO: 44473 - DNA, 446 bp, Homo sapiens
gaccaaactgtaacttcagctcaacttttcttccttgtggattccattcctctctcataattgcatcttatcttctctatcaacccaagctcagtatcttcggatcagagaattttgttgttgttctgattctagtcaaggtgtagcctactcactagacaggtactgggccaccaactgtttgttactagtttgcccaaattaagaacagaaattgaaagtaagcatttagaatcttacataacaatttgacattgctgagacatccaagtgtgtgagtttgtgttttaaatattcatctacaaccagttgggaacagcaaaagacaaagaaccaggccttcaccatctgtagtctgaaaagcgttgttctaccccattcctgtcacttcactccagcctggacaacagagcaagactctgtctaaaacaacaacaacaacaaca

SEQ ID NO: 44474 - DNA, 313 bp, Homo sapiens
gcaaatggattatcttcctggcccacaccatgttgcctgtttctttacacatggtgacaaaaaggaagatggagcctacacgttgaacatacctggcccccaggtagccattttgtattggcacagctgctggcagtaacctgtgcaagcttccagcttgcttatctatgtctgcagctcaatttttcaggctgctcttcattagacaaaagaagtttctcgggctgctttctgttagaagggaagccttgccaagaactcttaccctcactatctgcctaaataacttctatctcctgtgtcactaggagca

SEQ ID NO: 44475 - DNA, 417 bp, Homo sapiens
taatctccagattcccttgaaacctcgggtaagcacaaatgtattccttttccttgctatagaacagttttcttttgtttgtctggagactttgcagaggattacctgagttagatatattgctagaggatgtttgttgtattaggaattgtgaagtgtctgacattttttctatttgccagctactatgttagtatgccacggttttatggattcaaataaaaaacataagactcctatttcagaaaaaaagatagtattactcacaccatgacaaacatcagcatatttgcctttttcccttagtatcacaagatcccacacactttcccagcattcgcatacatcaactactgttcaacagacaaaatcgcggaacgtatccttcccctctgagctaagaaaaatgacagcttg

SEQ ID NO: 44476 - DNA, 524 bp, Homo sapiens
ccagtctttcaaaatgcaaggccaattactaccccttttctgtctgcgttctaccatcctttgaatgagccacaggtgggggtgccctgggtgactgcatgtgggtggctcaaggacacagggaaatggagggggaagccctgactaacaggtccaaatgttaacttccatctggttctctgtgggctaagaggaggcacctagtgctaagaagctgccagcagaagatgccctggcagcctgaccacccacaagtcctgacactcggatggccgcagtccactcctcctgcaggagacaggacctactgtgttagagtctctggtggcaggtgctcgggagatgggcatcacctgtcgtgtaacaccctttgcaaagaccgggagacatggtgaggatggcctgaaagtcaagtcaacttctattccattttctcctggggacgtgcaatgtgctctaagggcagcctagtgggtaggctaccaatgttttggaagataattcaaactgaaaacgttatattg

SEQ ID NO: 44477 - DNA, 415 bp, Homo sapiens
gctgaagggaagtttgcatcctcactgtattccacagtgtcttttccagtaagcttcttttccccctgagtcttatacactggttttattaatctagtctagaacattccccagaaattaacatctaatttgttgactccctttttttgttgttgatgttttttttttaaagaacagggcaacattttttcttctgtgggcctccagcccttctcccattcccttgactgccttagcgattactcagaagcagtccggggtaatgtgtctcagttccctcagtggcctggactgtggccgtctggtctctccaaacttgagctcattaaaagtagctaggtattatcttactatctcctcatcaatcttgagcttctattccttcttgaccatgtttgttccatgttttccgttt

SEQ ID NO: 44478 - DNA, 724 bp, Homo sapiens
cccgcaatccagtataggcgctaggtcacagctgctgccaagagagccttgggcgtttcccacctcatggacaatgcagactaggatgtttttagacccaaagacagagtgctgtttctatcccggtgctgtctctaatttgctatgtaactttggacaagtccccttccctctaggattcagggtcctgaagtagaaggtcaaagggccaccctgcctggggcctcagtttctgcatcagattcatagaaggcaccttacatgctatctccaactcctagctgatgcttaaacccctctaagacatctccaacaaacggtaaaccccatttctacttgagaactcccagtaacaggaagcttagacttaccaaggtgcccattgcttttctctagaatcagaatcgcaagtgcaattccaaactgtaatggtgtttttttgtttgattgtttgtttttgagatagagtctggctctgtcgcccaggctggagtgcagtggtgcgatctcagctcactgcaacctcagcctcccgggttcaagcaattctcctgcctcggcctcccgagtagctgggattataggcatgtgccaccacgcccagctaatttttgtatttttagtagagacagggtttcaccatgttggccaggctggtcttgaactcctgacctcaagtgatccgcccacctcggcctcccaaagtgctaagattacaggcatg

SEQ ID NO: 44479 - DNA, 581 bp, Homo sapiens
tcgtgtagctgaagtctagaaaactatcttcctccgaaaggaacagctgaaaaatagacagtgaatctttactcccagcagaccaatctttaatgagtcagagaagagagacaagtgtgggaggctgtgctgaggttgacattgttcccatgattgcatttgttaagacagtggtcaagataacagtcaggagatcaggcataccatgacttagatgtgtaactttggctaagcctcagtgttctcatgtagaaaatggtaaaagccctagaacccaacagtgggaagatattgaccaatatttttggatactttctatcagaatttccttcttagacttaggagataattattctaataaggaagagcccaacgcttagtatagaagttgattatccaagcatctccttctccccgtcttctgggtagcttgagtgtgggtatatacaacctaggctttccctctgccctccagtcagacacaccaacccaagactttgaattggaagctagtagtgattagacttagggatactgtagacaccattttgctgaggatggtgggagtagccacatccata

SEQ ID NO: 44480 - DNA, 430 bp, Homo sapiens
agtctgcactgttcctcttcctgggcagtgggaactcccctggagggttctcactctctctgggccagagctcagctctgaccgactcacttcttaactgtagggcttcctgctacagtggaaaggcactttagaaaatgtccagggctcaggccgggcgcggtagctcatgcctgtaatcctagcactttgggaggctgaggtgggtaggtcacgaggtcaggagttcaagaccagcctggccaagatggtgaaactccgtctctactaaaaatacaaaaattagcagggtgtggtggcaggcacctgtaattccagctactcgggaggctgcggcaggagaattgcttgaactggggcagcagaggttgcagtgagccgagatcgcgccactgcactccagcctaggcaacagactgagattctgtcc

SEQ ID NO: 44481 - DNA, 481 bp, Homo sapiens
gggcctggagtagccaagacaattttgacgaataaagtggagatcttgtttcatcaactctgtgaatttagaatgcattgatgatgcaggtgttgacaatggatcggatggaacaaagggtagagtgtaggagaagatccgctcacatgggaacaaagccatttttaaaaagataattgatcaaaagttcttggggccaggcatactggctcaggcctgtaattccagcaatttggaaagccaaggtgggtaaattatgtgagctgctgagtttgagaccagcctgggcgacatgacgaaaccctttctctgccaaaaatacaaaaattagtcgggcatggtggcacacgcctgtggttccagctactcaggaggctgagatggaggattgcttgagcccaagaggtcaaggctgccgtgagccaagattgcaccattgcactccggcctgggtgacggagtgagaccctgtctcaaaaaa

SEQ ID NO: 44482 - DNA, 475 bp, Homo sapiens
tatcaaaccacaatatgctgtgctcaatgttggggcttttacattcatatgaggatcagactcagaagcatgtgttctatgaccttatgctaaagggcagcattagttcaacttcagagctccctagaaatagaaaatgcccaccaatttttcaggaaaagcaaatcctactcaaactggaaggaacagtgagtaaatatttttgtcagctgggatcctagtagatgctgttaactatatcacagtggctctcagtggtttctaaacctgctctgaactaggtgcaagtgattcaaggagacagagccatgaagtgctcagtcacacagctagttagcactgagctcagattgaagtcagaccctcaaaatttggtggcagcagcatcagcatcatctgagaagttgtcagaaatgcaaatctctggctccatccaagacctactaactctgatactctgagctggggcatagct

SEQ ID NO: 44483 - DNA, 491 bp, Homo sapiens
cttagcctaagggtcctcagaatactgtttgaaaatttctgttttcaggaaaggcttactatagtgggtcttaatttctctaaggattctgatagcagccttagatagcaaatacttctaattcaaaggtattcaaaggacatttctcctgaatggtcgtctaattatacctttacatcttacaaatgaaataatcaaagcctagattttgatattcaaccaagagtttggttaaccatggacagtggcaaatccaggaataaactcagaactgttttgggtttttttttttgtttttgagacagagtcttgctctgtcacccaggctaaagtgtggtggtggtgagccaagatcacagcattgcactccagcctgggcaacaagagcgaaactccttctctaaaacaaacaaacaaacaaacaaaaccttttttgtttgaaaagtttattttagtcattttagtgtgtgtgaagattacttcattgtggg

SEQ ID NO: 44484 - DNA, 116 bp, Homo sapiens
ttattctgcaaatgaggatccagacagtaaagggcaagacagcacagatgttaggcttttggtcacatattcttttgttacatattctttgcattttttatttttaaaataccgct

SEQ ID NO: 44485 - DNA, 377 bp, Homo sapiens
cgtgggagtagggtcagcacagctggaagccagagggggcaggcgtgtgggtgcaggccctaaacagcagttcctggaggcagagaacaggagcctggaagggggtgcgagggatgtgtgctcactcactggggtctagaggtctggctttaaggcggaatctgaaaggctggggctgggtggaagtccttaatttggcttcgttttctgggtccttggagtgaggaattccaggcccagagccatgggatttcctgttgatttccgacttctctaagactcccaaggtctcgctcatgggcaggcactggaatgtcctccctgccaccttgggtgtgtgtttcagaagaggaggttcacagtgttctcccggaagg

SEQ ID NO: 44486 - DNA, 1001 bp, Homo sapiens
aaaatatcataaagatgtttatagtatttttttactttattatttaaatcataactaacaatatttttaaaaacttattttcattgctacaatgtcaaatattccaaaatcagccaactacagctatatatgtgttatgtgtgacagaagtgatcttccttccctctttttgagcttgacatgaaagtgaaagaagactcaatgaataattatgagctatttatttaataattacttgccttgggtgtaatacagtaatgaatgagtgaaacaaatattctcattgaatatgatacaatgctgttttctgtatgtttcatgttctattattaaaggtatccattaggccaaaattatttaatcaaattctttatctgataggtagattgagagcattttcttaatgcattaccttgtacataagtatacacttggtaaagtagacgaagttgaaatattaatttcatttggcatttagcatgtgaatatgattattgtttgattgtgtctgtatatttgtttggtgacgtgctcaggtgctcccactactgattaatgtgtgtgctaatatcctaaaaacacatatgaggtttaagaaaaaattttcttgtctgaaaacataaacatcttaataaaactgattttgaaataaaaactaaagtacttgaagatatgtcttgtttctaactatatgttgcatgccatgttggtgatttgctaatgtgtttttttgtttgtttgttttacccaaatccctttggaaaatctaatggacaaatgcaaattcttggactaaggactgtataaattgacctgaaaatacatgagagttgcatttaaaaaaaaatgcttgtaaatccgtcttgagttttactctatgtaaaaatatgtcttggttttgtgattgtatacaagatgtatcttgataacttatgtaaactgtgccgtataaaggctgttgcctcagccttactaataaatactgaaaatatcacctttga

SEQ ID NO: 44487 - DNA, 1746 bp, Homo sapiens
atagccaattctaagggatgtacttctgttattatcaacaaaaaccttgccaacagctgcggcactggctactctcaccttatatgtttagttcccaagatagcttgcccttttccgaacagcagtcagctcgactgtgccactaaaacagacaaatatttgctcgggaatcacaaccacggggacttgctcccccagttaggaccatggtacatatttgtgtgtatattatggtgttacatgcagattaatactttcaattaatcctcctagttgcctgtaacgttaacatttcaagatgcatttagatatttttatcctgtaggaggattttgtttatttgagggaaaaaaagggcttttaatgtattctcctcaaaaaccatttagagaaaacagataagtaaaaataaaatttaaattaccatatttctatttacagggatgagcacattaacattttatgtatttagtgatcctttttcctcatgtgtacacatatgtttttgtgtgttagtcttgcttgccctccccatagtctgaaatagttctatgaagtttatattatttttaaacttgatcatatacaaattttcaggaaacaaaccactctagctatttgaagaggaatgcagatttatattgggagttttgaaactacatagtttcttacaaaatcattggaaggttggaggagcggtttcaagcttaagtctccagagattactcccatccaaacatacagtattggtgtacctagggaactgctcacttttgcaacagtcagggagttcactgttggaactattaatgttagaacatgttgcagtagttgtgttcaaggaatgaggaacctgctgtaacacttaatgactgtgcactggaatgcagaaaagttaaaccttctatgcctaaatgcctaaaacagacaaactggatagttatatttttagaatgatactgcgttttttagagtagtatgaattcctagatcagtcaaacatgcatgttatttagtttgttctttagtatattgttaactggcctaaatccaatgactgacatggtaaagattcaccacttctagcatactgggcactttttatttttgacttgattacattaactttttgaaaactattcagtgatttattcagccaatcttatgaggtacatctgagttgttctagatgctagaggatagtataacaggaaaaagcccctgctctcatggtgagacagataataagtatgtaatacaacttttcaaatagtagtatgaatggtaaaaaaaatagggaaaaggggtgggaggagctgaggtttgatagaatggtcatggaagatcccattaatgagatgtactttaagtagagacctaaatgaagataattttttctctagtactgaactagcactgtacaagtggattgcatataggcatataggcagaacttctctagtactgaactaacactgtacaagtggattgcatataggcatataggcagaaccaatgtgcaataattaagaatattaatttgcaatcatgtttgatggttaaatggtttattaatgttggagtgtcaatatgaaaatgggttgaataaaagatatatggaaatgcctaggactactgctctatttactttttagcttatccatatattttatgtaatatgcttctttgattctttcttgtagcaatgataatataatattgaataaaccataaaaccagtgggac

SEQ ID NO: 44488 - DNA, 691 bp, Homo sapiens
  misc_feature (31)..(32): n is a, c, g, or t
  misc_feature (79)..(79): n is a, c, g, or t
caggtctcttcttatcatccccatccttacnnacatatgtgagatgtaaatctaataggcagttgaagtccagctgaantgtagcacattgatggtatctgccaatcttatgaggtacatctgagttgttctagatgctagaggatagtataacaggaaaaagcccctgctctcatggtgagacagataataagtatgtaatacaacttttcaaatagtagtatgaatggtaaaaaaaatagggaaaaggggtgggaggagctgaggtttgatagaatggtcatggaagatcccattaatgagatgtactttaagtagagacctaaatgaagataattttttctctagtactgaactagcactgtacaagtggattgcatataggcatataggcagaacttctctagtactgaactaacactgtacaagtggattgcatataggcatataggcagaaccaatgtgcaataattaagaatattaatttgcaatcatgtttgatggttaaatggtttattaatgttggagtgtcaatatgaaaatgggttgaataaaagatatatggaaatgcctaggactactgctctatttactttttagcttatccatatattttatgtaatatgcttctttgattctttcttgtagcaatgataatataatattgaataaaccataaaaccagtgggac

SEQ ID NO: 44489 - DNA, 1100 bp, Homo sapiens
ccatatttgtagagttctctgacaccagctgtttctgttgtgagtatagagtgattcagggcaggttggacaccagtgagtataatttctacaaaagcagtttgcaagagcctctcattctacctggaaattagtcacactgattctaattacaaggcttttgtgaccccagctgactggccacccctcccagagcaagcatttcaaccacccagctgcaatgtctggagactacttgatgttactaccactaaaagaactggagctcctgggggaaacccttcagatataaccactgtattatctgacagaaagcaaaagctaaggtggaagcccactcaagaaacttccaaagactcctgggtcctgggaaatacaggatgagcccatatggctaaagttagctttgttgttgagggaactgtagatttaattgctggctggatggtttgtgttgctactccccacaaagaaattgaccctcttcttcagagcacagcaaggggtacacattaccctagtgaaagcaccttctttgccctgctggtttcagctgcaggaagtacattcttgcagtatattcactctcacatccaatgtggtatatgggtaaaagcttttgtatagagaagaaaaagtcctctacatatgttaatttctaccccatgtgtagttattggtcttttgctgtgaatgttcctggtgttttaaagggtcatattaaacgttttggggcttctgagggattggggttttgaaagtcccctggaaagtgtcaacagatgttcaacaagtgatctaattctgggttttgggaaatgaagtttgtgaacttggctgggaccctcagggcttggagtcagatagctttgggaccttggagacatgacttaacctctctgggtctcagttttctcacctgtcaaatgggttatcccagaacttgccttatagaattgctgtgaaaattaaaagagataatgtacttagaatacttaactcagggccttgcttattgcaaatatttaatatataattgctattatattttgtatcctgtatactctataataaataacacagctaatgtttactgagca

SEQ ID NO: 44490 - DNA, 301 bp, Homo sapiens
ggtgttactaaaaagaggaagaaggaattttataatattttcacgagagtgattgtgttagattatagatataaattgggtaagagggagagaaaacacaaaagagttggtggatagtgaaaaactggtaggatcaaaagtttagaggtccccatgaggtgaaagaagtgaggatacatgagtctggacatggtggctcatgtctgtaatcccaacactttgggaggctgaggtaagtggatcacttgagctcaggagttggagaccagcctgggcaatatggcaaaacctcacctctaca

SEQ ID NO: 44491 - DNA, 254 bp, Homo sapiens
agcaaggggaaatgttttattacctttaaaaaaccttttttaaaaataccacaaatgtcaatcacagacaggtttcttttccctccctgtttaataccactaaacgactacattcaaagttaatttaaaactccactattgagactcactcaaaaaggctatatttattataattaattaacacccccttggctaaataacactgtttattagaagcctcttggaagccagagatgtttaaatggtgctataac

SEQ ID NO: 44492 - DNA, 348 bp, Homo sapiens
cccttcttccagacgaccgccatgatggcccccgacgccagaacctccaccacgggctcctggcggctgcagccgtacaccctggcagaacagaaaggtggcaaggctgggctggggtctgggaggggagtggcagggagggcggcaggcggctgctgggggagggtggacgggagtctggacatctgggttctgggtccgggtctcctaccagagaccactgtgtgtctgtggggagaattctgtgtctccccagccccagaggacagactgaaggccctccaaggaccaggctagctcctcgggtgagagaggccaggaggttccccagacttctggagcttacag

SEQ ID NO: 44493 - DNA, 752 bp, Homo sapiens
ggtgtattggaaacagctacactctcaagtcaggtgctttttttccctcaaaatctccaaactcaaagcatttataaggggcccttccaatgggcaggcacccccagccaccaaatcacagacttccaagagtaggaggaactgtctcctcccgaacccttccttgctttcctggggaagagggttcttcctgcagggaccctgggcatcctgctgctgggcctgggcctatagactgccctgccccttcttcccaaacactgagaagaccccgctggagatgaccccaaagccacgcctgctctacggccctaagcaatagacgcctgccctggctgctgatgatggtgatccctttgtcctttgacttggcagtcaaaaatggagtgacaccccagactcagtcaggaagagaacctgcagcctgcctcagctcaggctaccacgccaggctccactcgctggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagttaaatttc

SEQ ID NO: 44494 - DNA, 2419 bp, Homo sapiens
  misc_feature (1)..(1): n is a, c, g, or t
ngtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaacactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtgggg

SEQ ID NO: 44495 - DNA, 1234 bp, Homo sapiens
  misc_feature (1)..(1): n is a, c, g, or t
ngtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtatttccaggcttgctaagtactaaccaactcatccccagtaacactgcatgttcatatcctgaattacaaatcaaaatgagcaaacacgtgcataagcaaatgagaaaaaagaaggcacacatcaaatgatgagatgtgcagccagtgcaggtaccccgggagtgttgcaagttaaactgatgaaaagacgtttagtatttaattgctcctcatgtaacattactctgcttcagaaatgttttgtattttgatataaataaacatttgctaaaaaagttaaatttc

SEQ ID NO: 44496 - DNA, 1290 bp, Homo sapiens
  misc_feature (1)..(1): n is a, c, g, or t
ngtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaatttctcccacctggcttccctgtgtctgtctgtctgtccccgtgtctgtctgtctgtccctgtgtctgtctgtct

SEQ ID NO: 44497 - DNA, 1329 bp, Homo sapiens
cctgtacactggcatgcgcgcggtgcgtgtgcgtgtgtgtggactccctgtgagttcccctttctctcggttgtggtcgtcgtgctctctatgtggctctcgtattgtgtctcgccgttgagtttgttctccgggtctccgatgttttccctgcacgtggggccttttgggatgttctccgcctttcgctgtgtctgggtcacccagagttgggtgaacaagccatgtgggtggggaggggctacctcccccagaccccttacaaactctgtacctctcggtgcgcggcagcctcttgctgtagttcttcttttctggatatgactgtcagtttcgtcatgagatttcttgctctcatttcgaactctttctttcttccactttctttgggggcgacccccgatccatgccaggtcttcctgtgaagaccgttccaacctcgtttccatttcttgaatgttgagtattacaacatcactgcgctagggtgcttcatggtgctgttctcgaagaggccagttgggctgaatctccttcctcccactggctcctgatatcttgctgtattttgtcttctttctgatttttccctaggggtttggggtgggtgacttaggggcggcttttgtgttctccctctctctctctttcttttctgtatgtatgtatggactggttaaagtgagtttgggcagctgactttatggtatgggttggctgacttttgttcaacattaaagacaaaccaacaaattgtacagctgcacacagaacacctttgagtgtgaacttgaatggcaactagaggcttactttttgaacttcaggtatgtaactcaaaagtaaataaaaacactattttttcagtaagcttttttttcttctaaaagatgacttagaaatcaaactataagaacatgaaatcggtgctgtaccaaagccttatatgaacatattctacactctgtataacctgtctgtgaggagctccctgctctatcaccctcttctcaaaagcctgggaatgccagcgcgtgccaagcctggggctgggtcttggggacctgtgggccaagggcaccctgggaagtaaaagatgacggtgaggatgggacacccttctgctgcctgagcagactgcaaggaaaccagatgtgtgtgtgtgcgcgcacctgcatatatatgtgtgcatacctgtgcgtgtgtgtgcgtgtgcgtgtgtgcacgcaagagagtgagagcgggagagagctcacaggtgcacagtgtcatggtgaatgtactaagtacgagcttgaagggaggcccaggttggctctgggagtgggg

SEQ ID NO: 44498 - DNA, 415 bp, Homo sapiens
gaaaattacctcaagatataagaaaagagatgtgaactggaatgacttggtttggctacctgtaaggaaaaatgtccaaactttcctgtctttagttatgcagcctggagaatgtcatttcaatcacttctgcagttgctccactgaggacttttgaaatgctccttgtctacagatgacaggctccctcagcagagagggaacagagcttgtggctgtatctacatgattccaaacatctggattaaaaactgaaaacatgaggcctgtgcctcgatgattttcaaacaccttgcttttggcattgtaaagggaaacaatccagatagctggctagatgtttcagttttcattctgatatttgtcattgtgaaattatagtcgatgactagataaatgtatgttctctccacca

SEQ ID NO: 44499 - DNA, 797 bp, Homo sapiens
gatctgaattatagttctaatttattattactttttttctaatttactgatcttactactacaaagaaaaaaaaacccaaccaatctgcaattcaaatcagaaagtttggacagctttacaagtattagtgcatgctcagaacaggtgggactaaaacaaactcaaggaactgttggctgttttcccgatactgagaattcaacagctccagagcagaagccacaggggcatagcttagtccaaactgctaatttcattttacagtgtatgtaacgcttagtctcacagtgtctttaactcatctttgcaatcaacaactttactagtgactttctggaacaatttcctttcaggaatacatattcactgcttagaggtgaccttgccttaatatatttgtgaagttaaaattttaaagatagctcatgaaacttttgcttaagcaaaaagaaaacctcgaattgaaatgtgtgaggcaaactatgcatgggaatagcttaatgtgaagataatcatttggacaactcaaatccatcaacatgaccaatgtttttcatctgccacatctcaaaataaaacttctggtgaaacaaattaaacaaaatatccaaacctcatagtggtattattctttgttttacctgtggtcatcttaaactggtttttcagtccctctccacttccttcagaaccaaagaatctgttataagattcctggaaggaactgggcatctaactgttacaccaaatcttaagtgaataaaactttaccaaggcttctcagttaaaaaaaaaa

SEQ ID NO: 44500 - DNA, 477 bp, Homo sapiens
catttgggggctcctttactccacatctgatgtctgggctggggtgccttgaaggctagtggaatcagctgggaccaatgaccagaacacctacatgtagactctccatgtggtctgggcttctcacagtgtggtggctgggttccaagagagaggttccccagaggaagcatttagagagccagtgttccaaaagaacaaggacatttgataaccttgcctctgaagttacatggcatcacttctgttccggatttgtggatgctatctcaagcctgcacagattcaagggaggtggagatagagagatggagatctatatccccatctctcaatgggtagagagtcaaaagatttgtggctgtttttaaaactactacaagttcattttaaaacaagatagatgcttgagcccaaaagtttgaggctgcagtgaactatgatcataccactgcattccagcctggccctgtctca

SEQ ID NO: 44501 - DNA, 536 bp, Homo sapiens
gatactagatttctcaagagttatttgaaaaaaatggtttatttcagtcaggtagtatttctccattgtatgtttgtagtcttgttatttaaaataattttatctccagtgagatgaaattaatgtttcatttgtttaatgctcttgggaagtttagagatcctaatctggacagatgctgaaaattttttactaatttttaaattcttattttacatataatttaaatttattatgaacctttacaaatatttcttactggggctgagtgcaatagttcacgcccataatctcagcactttgggaagccaaggcaggcggatctcttgagtccaggagtttgagaccagcctgagcaacatagtgaaaccccatctctacaaaactacagaaattagttggacatggcccatgcctgtagtcctagctgctcaggaggccaaggcacaagagtcacttgaacccgggaagcagaggttgcagtaagccacgatcatgccactacactccagcctgggtgacagagggagaccctg

SEQ ID NO: 44502 - DNA, 634 bp, Homo sapiens
ttgagacagattctagctttgtcacccaggctggagtacagtggggcaatctcagttcactgcaacctctacctcctgggttcaagcaattcttctgcctcagcctcctgagtactgggaccacaggtgcccaccaccacgcccagctaatttttgtatttttagtagagacaggagttcaccatgttggccaggctggtcttgaactcctgacctcaggtgatccacccgccttggcttccgaaagtgctgggattacaggcatgagccaccacgcctggctaagatcattattttctgtttttagtcaggtgatctcataatcaaaaaatgtttaattgatgatttgtcaatttgtagttttggccactaaaactacaagagttaggatgcacctttatattacagtcatacataacctcagctagtgaagaaaaactgctctatttgtggaagataagatactttttacatcccctttatgatattttaaacccttagtgcatgcaggtatatatgtagactcatgctgtctttaaatcccaaacctaatatattactgtagtactttaaccctcaagtgttttgggggttccttcttaagtgaaacccttaaatatcaattgatgaccca

SEQ ID NO: 44503 - DNA, 468 bp, Homo sapiens
cgtaattctgtatgagcagtttgggtctcattccccaggctgactgagagcaagactgcacctctaataaaattaaataaaaactaaaattacaggcatgagccaccacgcctggctaagatcattattttctgtttttagtcaggtgatctcataatcaaaaaatgtttaattgatgatttgtcaatttgtagttttggccactaaaactacaagagttaggatgcacctttatattacagtcatacataacctcagctagtgaagaaaaactgctctatttgtggaagataagatactttttacatcccctttatgatattttaaacccttagtgcatgcaggtatatatgtagactcatgctgtctttaaatcccaaacctaatatattactgtagtactttaaccctcaagtgttttgggggttccttcttaagtgaaacccttaaatatcaattgatgaccca

SEQ ID NO: 44504 - DNA, 433 bp, Homo sapiens
ctgtggtgaaaggtaagactcaatatatggataagtctgtgtgtatacggccttaaagaatcacagtagatttgaagtttatcctgtaatgacagtagcatttacagaaagtttctgttggaaatagaaaaaaaatggaaaacatatgagtatagaagaaaaacaattgaaattccacttttaaaagtgatatattttccttctccttaccccttcaaaaataaatcagaataacactgtatgtaaaagttttgtgatgtgatctttatgtaacattttgaggatttttccttattaaatagtctttgtggccaggcatggtggctggtgcctgaaatccaaggactttgggaggccaaggtgggaggatcacttgaggccagaagtttaagaccagcctgggcaacaacatagcaagaccctatctccaaaa

SEQ ID NO: 44505 - DNA, 797 bp, Homo sapiens
aaggcgactagggacgcatgcgcttgcgatttcctagcactcccaactccagcatacggcctcccttgataggcagaagcacgtgtcttgttgcgacctgaacgaacaataagtgctaggtacacagttggtgtctagtttttcttttcctcgatggaaattgtttcgtgttgtagcccatttaacacttccccctccccccactcttctcctaaagagcccgaacagctgaggaagctcttcattggagggttgagctttgaaacaactgatgagagcctgaggagccattttgagcaatggggaacgctcacggactgtgtggtaagatttggaagggacaaagcagtaaaacagccgatttccttggcttatcttggtgcagtcttctccgaatgcttatgaaagtagttaatagcattatagttagagctttgttggcaaaggaacgtcctgctttgattttaaaagctacctcttaaatctagggtagtgggaaactggacgactttttataaaaggctggtgtaaagtttcctattgccctattcaaagttaaaatgacaaaagcttttgcggtcagactttgtgttacataaattaacactgttctcaggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaaattctcaagacggcacgcggggtacgagctcgaa

SEQ ID NO: 44506 - DNA, 599 bp, Homo sapiens
  misc_feature (422)..(422): n is a, c, g, or t
  misc_feature (437)..(437): n is a, c, g, or t
acctgggaccttaacaggttcaccgctttagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatttgcctttagaacctatgacgaccatgactgcgtggataagatggcagtcagaaatctcatctgtgaatggtctacactgtgaagtagaanagccctgtcaagcangagatgctagtgcttcaccagtcatagatgtcgaaatggatctggaaacgtttgagctggtctcgaatgtgttttcgagtgcactacaattaagtcgttgaggaaacttcagggttcgaaatgctttagtaggagactggtgatacggatacgtggccctga

SEQ ID NO: 44507 - DNA, 3568 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44508 - DNA, 3412 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44509 - DNA, 3788 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44510 - DNA, 4241 bp, Homo sapiens
  misc_feature (3646)..(3646): n is a, c, g, or t
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaacttaaaaaaaaaaaaaaaaaaaaaaaaaaaaaaaaaaaaaaaaaaaaaaaaaaaaaaaaaaaaaaaaaaaaaaaaaaaaaancccttgggggcccccttggcccaatcaaatttaaaattaaaaaaacttaatcattgcgcccaaatttaaaccaaattggcaaaatcccccaaaaaggaagcgaaaaaaaaataaatggcccgcttttaaaaaacgtggaaagggaaaaaacctggggtaaacaaaataaaatcgcttggaaaaaaacccccttttcccaagtgggaaaaaaaaaaaaaagccccaaaccaaccccctttcaaaaaattggccaaccctaaagggaaaaggaaaattgaaaccttaaaattttgtaaaaaaccccggaaaaattttggtaaaaaaacctaatttttaaccaaaaagcccaaaatggaaaaaaccctttaaaaacaaaaaaaaaaacccgagaaaggggtaaggggttttctccattttgaaaaaaaaaccccaatataaaaaaacggggcctcaaacccaaaagggaaaaaaccgttttaaagggaaagggcccctcccgaaacacaacccaaaaaaaatttttggggggggagggcgccaaaaaccaaaattgaaccccaagggggccccctttactttccgggccccaactggg

SEQ ID NO: 44511 - DNA, 1780 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgattta

SEQ ID NO: 44512 - DNA, 3597 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaccctttgaacttcatgggtgcaagttcgggtgataaagaaccgtctgttttaataccttggttttagccaggggaccttggtttttcttttgccatggcagccttagcaagagagtgttagggccagcttcctgagttctcatgtttcgagcacgtgggtgtgttttatttattatggatgattcttgttattcttaactta

SEQ ID NO: 44513 - DNA, 3430 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaagaaaaattgtacttttcaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44514 - DNA, 2453 bp, Homo sapiens
  misc_feature (1858)..(1858): n is a, c, g, or t
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaaaaaaaaaaaaaaaaaaaaaaaaaaaaaaaaaaaaaaaaaaaaaaaaaaaaaaaaaaaaaaaaaaaaaaaaaaaaaancccttgggggcccccttggcccaatcaaatttaaaattaaaaaaacttaatcattgcgcccaaatttaaaccaaattggcaaaatcccccaaaaaggaagcgaaaaaaaaataaatggcccgcttttaaaaaacgtggaaagggaaaaaacctggggtaaacaaaataaaatcgcttggaaaaaaacccccttttcccaagtgggaaaaaaaaaaaaaagccccaaaccaaccccctttcaaaaaattggccaaccctaaagggaaaaggaaaattgaaaccttaaaattttgtaaaaaaccccggaaaaattttggtaaaaaaacctaatttttaaccaaaaagcccaaaatggaaaaaaccctttaaaaacaaaaaaaaaaacccgagaaaggggtaaggggttttctccattttgaaaaaaaaaccccaatataaaaaaacggggcctcaaacccaaaagggaaaaaaccgttttaaagggaaagggcccctcccgaaacacaacccaaaaaaaatttttggggggggagggcgccaaaaaccaaaattgaaccccaagggggccccctttactttccgggccccaactggg

SEQ ID NO: 44515 - DNA, 3510 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44516 - DNA, 1649 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttattcaccctgtggctgggagccctgtttccgcacctgtggttcgtcctgtctctgtggcccggtccccttaggggtcccgccctggggtttcacgttggggcctgccctctggaggccc

SEQ ID NO: 44517 - DNA, 3540 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagaggtgagttaggcgcgctttcccacttgaattttttcctctccctttcctgaatcggtaagatgctgctgggtttcgttccttgcaccagcccattctacagttccttcggtcgctgccacggcctaccctctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44518 - DNA, 3194 bp, Homo sapiens
tttgcgctccattcagagtgtgacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44519 - DNA, 1450 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtctttaaaacaaaaacaaaaaaactccgggctcttg

SEQ ID NO: 44520 - DNA, 3045 bp, Homo sapiens
gcttgagaatcttctctggagaccaggtgcccaaatatctttttcacagttaagtgggcacctggtctgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44521 - DNA, 3357 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44522 - DNA, 2940 bp, Homo sapiens
gcactgaggtacatcacctaatatgattgttcaaactgtctttttatattgacgtggttagatatatgacgtagcgagactgatgtagataagattagtcgacttagaacctgtggctaccatgacttaccgagctcatattcgttcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44523 - DNA, 1409 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggtaggtatccagtgatccaagtacttggtgtgacagctagattagccttttagagcttgggttctggtgctgttgaagcattgtgtggtacactgcatggtatattaaaaacaaatgggcttgctatgctacctcctcctagctttaagctggggccgcctcactcccaaatagtagagataagtggatagtgttgtctttgagttagattagtatcatagaaggatttagtattttaactcctttgggaccttaggcgcttagttgatgtatccaagatacttctgcttgctgtggccctggatccgtgaaggccttcaaggctgaagggtatgcttgtgccactctgaaaatctctttattttatgtcatggtg

SEQ ID NO: 44524 - DNA, 2928 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgactatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44525 - DNA, 2940 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44526 - DNA, 2951 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44527 - DNA, 2511 bp, Homo sapiens
  misc_feature (10)..(10): n is a, c, g, or t
cccccccccncccccttcccctcctcaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44528 - DNA, 856 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtgctctggtagcagccgtggtgatgctcaaagatctttgggggatcctctgac

SEQ ID NO: 44529 - DNA, 862 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtaggtatgatgaggtaggtatgatgaaggacg

SEQ ID NO: 44530 - DNA, 1948 bp, Homo sapiens
  misc_feature (36)..(36): n is a, c, g, or t
  misc_feature (75)..(75): n is a, c, g, or t
  misc_feature (97)..(97): n is a, c, g, or t
  misc_feature (139)..(140): n is a, c, g, or t
  misc_feature (149)..(149): n is a, c, g, or t
  misc_feature (154)..(155): n is a, c, g, or t
  misc_feature (160)..(160): n is a, c, g, or t
  misc_feature (163)..(163): n is a, c, g, or t
  misc_feature (166)..(169): n is a, c, g, or t
  misc_feature (173)..(173): n is a, c, g, or t
  misc_feature (176)..(176): n is a, c, g, or t
  misc_feature (180)..(181): n is a, c, g, or t
  misc_feature (190)..(190): n is a, c, g, or t
  misc_feature (194)..(195): n is a, c, g, or t
  misc_feature (205)..(206): n is a, c, g, or t
  misc_feature (221)..(221): n is a, c, g, or t
  misc_feature (230)..(230): n is a, c, g, or t
  misc_feature (247)..(247): n is a, c, g, or t
  misc_feature (259)..(259): n is a, c, g, or t
  misc_feature (261)..(261): n is a, c, g, or t
  misc_feature (263)..(264): n is a, c, g, or t
  misc_feature (276)..(277): n is a, c, g, or t
  misc_feature (280)..(281): n is a, c, g, or t
  misc_feature (290)..(290): n is a, c, g, or t
  misc_feature (300)..(300): n is a, c, g, or t
  misc_feature (302)..(302): n is a, c, g, or t
  misc_feature (306)..(306): n is a, c, g, or t
  misc_feature (310)..(311): n is a, c, g, or t
  misc_feature (313)..(313): n is a, c, g, or t
ctgtttttccctttggggccgctttttcctttctcnttggttgctttttcttggcttttgtctttttcctttctntcgccggttgttttttttctcntggcttttgttgttcccggtttttttcttttccgttctcttnngtttttttnggttnntttgnggnttnnnntttnttngggnntgcccctgntttnntttttctccnntttctttttttgagntggtcttgnctctctgtccctttcancattttcggctntncnnttctctcttttnnttnntgttttttntggattctgntntttnctgnntnccgattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44531 - DNA, 654 bp, Homo sapiens
cgagctcggtaccccttttggggtctttgctcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44532 - DNA, 294 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagaggtgagttaggcgcgctttcccacttgaattttttcctctccctttcctgaatcggtaagatgctgctgggtttcgttccttgcaccagcccattctacagttccttcggtcgctgccacggcctacccctcccaaagttcaagtcgccatttt

SEQ ID NO: 44533 - DNA, 3643 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44534 - DNA, 3358 bp, Homo sapiens
ggctagtagcctcgggttaatcggagaggccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44535 - DNA, 3354 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44536 - DNA, 3330 bp, Homo sapiens
ccagaagccgcggtaaatcggcagtctctcttcaccttaccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44537 - DNA, 3284 bp, Homo sapiens
caccccctccctcctccccaccactattactagctcgactcccgctcttatctcacttcgaggctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44538 - DNA, 1299 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44539 - DNA, 3513 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44540 - DNA, 1160 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattagaatcatagcttagcatgattgtagatctagagcagcggccagtgagcccctggtcacggtcatagcg

SEQ ID NO: 44541 - DNA, 3243 bp, Homo sapiens
ggtaggacaggatgtggggtaggagatggggagagagcaggggacagacgtctgtctgtgagcacagaaagccagtgctgacgaaggaagtccccaagctcactccctcagttccagcggctgatccagtgaaggcgtttgtgcgtgtgctgtcacattttccccctgaactctgtgatccttcatgagacacagtatttctgttctcttgctgtgtagaccctcccccctccaaaaaaaaatctcatcggactgctttcttggtggcggtgggtaaagcaaacgtacattctctcctctcagtactcgttcacctgagccagctcgggtgtcaggttgacagttatgtttttatacaaggcgtcgtatgtgatgtttgcaaaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggtggttatggaggaggcggccctggttactctggaggaagcagaggctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44542 - DNA, 2843 bp, Homo sapiens
gttagacatagaccctgttcgatagcagccgacgactggccacgtgtcattgctatcctagaccaataggatggcgtcgacctgtggtctctagggaagaatctctgggttgcgattggatctgatggtgacgtgtgggattttctgcgatcgcgagataatgaaacaacgtctccggggtcggtgagacgcgaagacgtttcatgtagagctacagttgcgctaggactgtaggttggcgagcgctgagtgtagggggatgcgatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44543 - DNA, 2678 bp, Homo sapiens
aatgggtcgatctaaggatcccttattcgtgtgctatggaagtggtggacagggttatggaaaccagggcagtggctatggcgggagtggcagctatgacagctataacaacggaggcggaggcggctttggcggtggtagtggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44544 - DNA, 967 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatgtaaactttaatagtgtagggagctgaataatttatgaagagaagggtcaggctgattcgggagatcccatacaacacggctctcagacca

SEQ ID NO: 44545 - DNA, 2545 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcattttaatgaacgtaaagataggcttacattaaaggaaaactgcagtttgactgggttctggttgggtgggccttcagaggttctatcagttaactatactaattaatttggagattcaaaccataccaatagaaactaaatttttctacataatttcatgttaactgcagtttccctttatggcacaaggggtcacacaacctacctaaaatgttaattgtatagaaaatgatttctaaacctttaacagttaatatccaataatgtgttatttgtacatagattcttttgagccttacctttggtgctctctcaatttcagtgctattgtacctagtagcatagagatttgtctatcaataggactgtatattccatcccatgggtgtgttggaagtttggggaggaggagggtggtgggaggtgggtgggaggtggtggtgggtgggaaagcatgggtgatagttccatgatactggctgagtttgcaatagcaggtggaaccctaactattgagggagtttgcagatacctcaggattcgtgacaatgcctttaaagatccaggagagatgttcagctactaggaactgctagcaagtatagcgcgaatggctccgagctcagacactctacagctgagagtagacacttgtggtatgtggagtacagataagccaggggcaggccacggcacgctccatgaaagctaggagggagtgaaatatcagtgatcatcgcaaggaaggaggcagacaagagtaaggcacacctgactcttaggactagcagtcagaaccaggaggaaaggttttattgctatgcgggtaggtaagaacagattttacttacatccatatagttacttaaagtccagttttctgttaaacatttttcttaatatattgagccaaaactagtccagttaagctgaacttggtttttctggagatgaattgttttaaattgacaccctattgatggctcccagttgaaggaagtgagcacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggaacgtccttgtgaagacctttatctgagccactgtacttcgttatcactgccatgcagtttacatgagctgttctgcagctcaaattccattttgtgaatgggtttttttttttaataaactgtatttaactta

SEQ ID NO: 44546 - DNA, 935 bp, Homo sapiens
acctatatggattcgagcccattggagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtactatgacagctataacaacggaggcggaggcggctttggcggtggtagtggtaggtatccagtgatccaagtacttggtgtgacagctagattagccttttagagcttgggttctggtgctgttgaagcattgtgtggtacactgcatggtatattaaaaacaaatgggcttgctatgctacctcctcctagctttaagctggggccgcctcactcccaaatagtagagataagtggatagtgttgtctttgagttagattagtatcatagaaggatttagtattttaactcctttgggaccttaggcgcttagttgatgtatccaagatacttctgcttgctgtggccctggatccgtgaaggccttcaaggctgaagggtatgcttgtgccactctgaaaatctctttattttatgtcatggtg

SEQ ID NO: 44547 - DNA, 2938 bp, Homo sapiens
ggggggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgccttttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 44548 - DNA, 364 bp, Homo sapiens
agcctttgtttcaccttttcctgtcactgggagggccccttgggtctcgctgtgcctggacgccaggctttttgctttattttttcatccctaagggtccattggtcaagtcagggggtaactcagttaaaaggatttttccctcaggaccccagctcttgcagtgaataaagttttatgttccctgcttttaatgttaaaaaaaaaaaaaaagggcggccgcccttttttttttttttttttttttttttttttttttctatctgttcttttttgaggctcagggagaaactagcatttttttttttccaaactactttttgtcactgtgacagttgtaaataaagtttgaaaatgctttcca

SEQ ID NO: 44549 - DNA, 2049 bp, Homo sapiens
gatcgagctcgtaccgtctgagcagctgggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 44550 - DNA, 3286 bp, Homo sapiens
ggggggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgccttttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttccaaaaaaaaaaacaacagtaacacgcacgcgacatagaacaaacatcacaagcacaaaacaacaagacggagagacagcagacaaacacagaacacaacagccacacacaagaatcacagacacaaccgaagaaaagaatcaataagcaataaagcaagagcgcggccgaaagcaaccaaaagcacagcaccgacgccccagaagccaacggacccaccatctagagaggacagcgcggacacataacagaagacgaagcgcgaaagcgcgcaggagcaagacagaccgaggggcagcagcaggaggcgaactacagaccaagcaccagctccggcagacaacaacaccc

SEQ ID NO: 44551 - DNA, 2964 bp, Homo sapiens
ggggggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgccttttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttccaaaaaaaaaaaccaaaaagggcggccg

SEQ ID NO: 44552 - DNA, 1494 bp, Homo sapiens
ggggggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 44553 - DNA, 2397 bp, Homo sapiens
ggggggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactgccccgactatctgagatcggccaagatgactgaggtgatgatgaacacccagcccatggaggagatcggcctcagcccccgcaaggatggcctttcctaccagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgccttttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcaatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 44554 - DNA, 275 bp, Homo sapiens
gcgagcccctactactactaaatttgcggccgcgtcgtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttcca

SEQ ID NO: 44555 - DNA, 311 bp, Homo sapiens
ccttctctgggctgtgacccacaccctctggagttattttctattcagtcacaaccttgctctccactaactgtttcttgatgcacacttcatgacaattcctatttctgtgtagatgacccataatagggtagatattaaccattgtagaggtgcttttcattatttttttaaaataactttttctatggaaatagtatttgttcattgcagaataatcaggaattacagatacgcaaagcagaggttgcagtgagctgagcttgcgccattgcactccagcctggatgacagagcaaaacgcagtctca

SEQ ID NO: 44556 - DNA, 578 bp, Homo sapiens
atttggtagtaatctctagtaattactgtaagtgctaaccagttcattttccaaatcacttttccttttgggcgttcactttattttgtacgttttaattgagtttttttgtaaaatggcctaacaatgttttacattccatggccttagccagggctgagcatgagaatccgcaagccactgggcccagttttgttttcagcatctggatagttgctgcttaattcatatgaatcctcatgtgtttccattactgtcagcatcaactaagacatttttgagccctgagtatctttgtggtattataataggggaaaataaaatactgaattaatcaaaagataaggcccgtggagtttgtgacccagaagagatataggcacagacagagtggagcaattctgatgataggttgtagatggtcaagagagccgtggtggtttgtcagcatggcagacgtttgtgagtgtgtagattttaattatttaaacatttaattttttaaattatttaaaaaattatttaatttcatgttcttcctggctttacaaattgattagaaaaagcccaagaactga

SEQ ID NO: 44557 - DNA, 837 bp, Homo sapiens
gagtaagattttagcacttcaagggtaaaatgcataaaagtattttttattttacccccctgaacttaagaaagaaaagagtttgttcagtttgtgtttttggaaagttctatgcaaaaatatatgttccagtgaataaagtagttttgggttgccttccatcataaggtatcatacgaggtacttcaggggacggaaaggtgattacaatgagatgagtggcagccagagtctaacaatggttaatgagcacaagacagcagatgtattcaaggtggaatcaagggaggcctgtgagaggcttgagtgctaagaaaaggaagaaacgtcagtcagttgggatgtggatgttagggcacttgaagttatctgtgctggagattgaatagattttcagtgatggagatctggggagagcattgtccctcagagctgttgaaaagtaaagaatctttctttttcaaaaattaaccactaaagaagtttatgattgttttctctctctttacttcacggatattttgaaaatacagattttagttcttagtttggcaagttgtttagcttctggggagagggtcctgtggacagtggcagcttaggaagcaactggaggtaggcctctaggagtcctgtgtgaggcttctcagaagtgccaggtgatgctctcataccttggaggtgggcatgcagcccccaagattgtgaaggagtggctcagtgggatcagagagacaaaaacactactggacactttcagaaattttctggtcaaatttcatcatgagctatttgcccagattagttttcttcaccaaaaacaaaaacaagcaaaca

SEQ ID NO: 44558 - DNA, 530 bp, Homo sapiens
tatatctgataagggtctactgtccaaaatgtataaaggactcttaaattcaacagtaaaaagacacaccagttaaaaatgggcaaaggattcaaatagacacttctccaaagaagatctacaaatggtcaataagcacatgaaaaggtgttcgatgtcattactaattagggcaaatcaaaaccataaccactacaaatggtcaataagcacatgaaaaggtgttcaatgtcattactaattagggcaaatcaaaaccataacgtggttgggcctggtggctcatgtccataattccaacatttttggaggtagaagtgggaggatggcttggggccacgaattggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctac

SEQ ID NO: 44559 - DNA, 325 bp, Homo sapiens
gctactactactactactactaccacccccccggccgctcggcaaatcaaaaccataacgtggttgggcctggtggctcatgtccataattccaacatttttggaggtagaagtgggaggatggcttggggccacgaattggagaccagcctgggcatcatagtgagaccctgcctctacagagaattaaaataaaaaattaggccgggtatggtggctcatgcctgtaatcctagcactttgggaggccgaggcgagtggatcacctgaggtcaggagtttgagaccagcctggcaaacatggtgaatgaaaccttgtctctac

SEQ ID NO: 44560 - DNA, 2222 bp, Homo sapiens
catttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttacctaatttttttcttgagatgcttttgtagtttttcagagttttagatgattttatacaaaatcctctgcctagcactgctctttttgatgttgtagtgacaccatttacattgaattaatgcttggtagcctggggctagatgtggaactccatggatctgtgttctgactggcacctttggaatgaaagaaaagtgtgtgctgtccaaattttttccccttaattctttccctcatcttctcacccataatagaaattttatttccattgtgagttctgacaagaatgaaattccacatacaacataactgtaaattgttggtaggtagaagttaatatttgtggttcatgtatattttgaccagagtatatttaagtatataatttcagcttccttgatttagaaatatgatataataaagaaaaactccatttatcatctgttaaaaaata

SEQ ID NO: 44561 - DNA, 1771 bp, Homo sapiens
catttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaaaattttgccattaaaataaatgatttctcactgagaggaacttttctaccaggttggggcatatgggagcttaatatatcatatctaatttaaaataatttcactgaaataaactccattgcttttaccta

SEQ ID NO: 44562 - DNA, 421 bp, Homo sapiens
  misc_feature (296)..(296): n is a, c, g, or t
  misc_feature (351)..(351): n is a, c, g, or t
  misc_feature (378)..(378): n is a, c, g, or t
  misc_feature (389)..(389): n is a, c, g, or t
  misc_feature (405)..(405): n is a, c, g, or t
  misc_feature (419)..(419): n is a, c, g, or t
ggcacgagaactggaacaaggatgcctctcttagcacttctattcaatgtagtactggaagtcctagccagagcaatcaggcaacagcaagaaataaaagccatccaaataggaaaaaaagatgagctctctctcttcatggactacatgattctatacctaaaaaaccctaaagactataccataaggctcctagagctgataggcaactacaataaagtttcagggtacaaaatcaatgtacaaaagtcagcagtgacatttaacctaagggggcccaaaacagggaaccacanttcccattttttaccattagggcccaccaaaatttaaatttttcttggggggttnttaggccttatttccaggggacggttnaaggtttccantttaccgggggggggntttttcccaaacantt

SEQ ID NO: 44563 - DNA, 638 bp, Homo sapiens
ccagccctgccagatgtgcttcagtttctcaatgctaaactgcttcccatcttagggccttggcattggctgtgcctctgtgtggaaggttcttctagatcttcatatacatgtaaccttcctcagcaaggctattccagaccacccaattcaaattagccaccaagtcgctctctgacctattgccttgttgtacttcactgtctggcttctatgtctaagtcttatttttcttgtttatttatttatttttttcccttaccaactaattgtctgtggccagctcactggagcctaagctctatcatagcaagactttatatactttgtatcactgtgcctcagtgccttaaaaagtgcttggtacctgatggtttcttatttaatattagtgaagtaactgagcaagaatgacaattatttgattgcctgccacgatggttagatccaatcctgagtgatgtgttgagttttttgagttggagagagagaaactggaatccatccacaaatgagaaactagaatagcaaagggtatacaaatggtacttgtagggtaggaactggcaatattcaatctggaaaatatttaaatgactaggaaatagaaaaacaaattacaagaacacagtatccaa

SEQ ID NO: 44564 - DNA, 908 bp, Homo sapiens
ttttttatcagaccacacctgttgcataacttcactactcagtagtcacacacatccacaaacttgtccactttaactcattctctctttatttcattctctgacttatttaattgtacaatcttgaagttagaagaatcatgagcccaattctttcccaatatagaaatctgtattctattggtagttactgaaatcttagtgattaagagcatggctttggagtcagtcaagacctatcatttattggctttttggccttggatacttgactcttctctgtttcatcagctgcaacatataattaataatagatactacatagtaagaactaaacatttgtcattttccattaagggtctccttgcacaactcttcaggtgagcacctgattgctgtggcagctggtttttatgtgtgaatgagatgatctctacttctctataattacccattggtttgttctgccttctggggcagtcaatctatacaaaatgtagataaaatctctttttcagagaactactctctgaagtacctgaaagctgtattcatgccctctgagtagtctgttttctgggctaaacagcttcagttctttctgtaacttcttagggcacagtcctgatttggtttctggccccttgaaaattgtgattactgtcgttgggatctggtctgagatagcagtgtccttttttaaagtaggatactcagaattgaacttgggactccaagggtagacaggccagctcagcaatgaggtgagctctcctatcttgtattccctttaatgcaattgaaagtaaaatagcactttcttggtagctacatagcacaattgactaatgttgagtagatggtcagccaaaacctccaagtctttttcacatttgttattcttttaa

SEQ ID NO: 44565 - DNA, 388 bp, Homo sapiens
ccccacccccggtctgggggctgtgccagctgatgtcagctctgagggtggcaggaggagctgcggctcacaggatcctgcattggggcgagttctggaacttcttgaagccttggtttttccaggctgcccagttatgaatggcagctcgctcctccacctctgccgcctgggcagtggcctcagccaggtgccaggcaggaacccctcaaatcacacaagccctgtccattcagtctgtctgctatattccacttactagctgcagatttttgtttgcagctttggtcaatggtatataccatgtttttctagaggaaagaaattacagtaatttaagattattagattggaaaatcatcacaagaaaataaaataatttttcttt

SEQ ID NO: 44566 - DNA, 391 bp, Homo sapiens
tggtcagggtggggaagtggggggacctggggtctcgggccctggacctgtcctaggacctggaaccagggcatggtgggtggtgagttatttgcttgggaaacttggatcctgctgacccgcagagaatggaagtggagaccccctgagtcggcagctcctggacccccggcctcgctctgcctgatgggtcggtggggaaactgaggctggcattccctggaaccctgccctcgtcctgcaggaaaataaactttggtgatgggagcacagatgtgctttggtgccatcttggtggcctctggcccaagaaggccctcttggtgtccgcagacccctctctgtgacccgaccctcctgtgacgtggcccgattcctgggttcaagtgac

SEQ ID NO: 44567 - DNA, 1359 bp, Homo sapiens
cttggtggatcatcaaccctgatggggggaagagcggaaaagccccccggcggcgggctgtctccatggacaatagcaacaagtataccaagagccgtggccgcacagccaagaagaaggcagccctgcagacagcccccgaatcagctgacgacagtccctcccagctctccaagtggtctggcagccccacgtcacgcagcagtgatgagctggatgcgtggacggacttccgttcacgcaccaattctaacgccagcacagtcagtggccgcctgtcgcccatcatggcaagcacagagttggatgaagtccaggacgacgatgcgcctctctcgcccatgctctacagcagctcagcgagcctgtcaccttcagtaagcaagccgtgcacggtggaactgctacggctgactgacatggcaggcaccatgaatctgaatgatggggctgactgaaaacctcatggacgacctgctggataacatcacgctcccgccatcccagccatcgcccactgggggactcatgcagcggagttctagcttcccgtataccaccaagggctcgggcctgagctccccaaccagctcctttaacagcacggtgtttggaccttcatctctgaactccctacgccagtctcccatgcagaccatccaagagaacaagccagctaccttctcttccatgtcacactatggtaaccagacactccaggacctgctcacttcggactcacttagccacagcgatgtcatgatgacacagtcggaccccttgatgtctcaggccagcaccgctgtgtctgcccagaattcccgccggaacgtgatgcttcgcaatgatccgatgatgtcctttgctgcccagcctaaccagggaagtgtggtcaatcagaacttgctccaccaccagcaccaaacccagggcgctcttggtggcagccgtgccttgtcgaattctgtcagcaacatgggcttgagtgagtccagcagccttgggtcagccaaacaccagcagcagtctcctgtcagccagtctatgcaaaccctctcggactctctctcaggctcctccttgtactcaactagtgcaaacctgcccgtcatgggccatgagaagttccccagcgacttggacctggacatgttcaatgggagcttggaatgtgacatggagtccattatccgtagtgaactcatggatgctgatgggttggattttaactttgattccctcatctccacacagaatgttgttggtttgaacgtggggaacttcactggtgctaagcaggcctcatctcagagctgggtgccaggctgaaggatcactgaggaaggggaagtgggcaaa

SEQ ID NO: 44568 - DNA, 383 bp, Homo sapiens
gaaaccgtggctggtgcgtgccacatctatcacacctcggtctacaaaacagtcctgacgtcaaataaaactattgtggccgggcgcggtggctcacgtctgtaatcccagcactttgggatgccgaggcgggcggatcacgaggtcaaggaaatcgagaccatcctggctaacacggtgaaaactcgtctctactaaaaatacaaaaacaaaattagccaggcatggtggcgggtgcctgtagtcccagctactctggaggctgaggcaggagaatggcgtgaacccgggaggcggagcttgcagtgagcgtagatcgcgccactgcactgcagcctgggcgacagagcgagactcagtctcaaacaaaaacaaaaacaaaa

SEQ ID NO: 44569 - DNA, 624 bp, Homo sapiens
cgaagacactcttttggagccatagcaacagaggagcgtgagtttggcctcggctcaggtcataggtggaagtttctgctgcccttcggcgctccagggcaccgtggtgaggacagtggatcctgcggcccccaggcttcatcctcccctttcttttgtttcaaggaggggctccgtggctcagggggtttgaaaagcaccgttttcgagatgggtgtcatgaagagggtgcccagaaaaaacgtcctggcatttgattctcacaggctctctggaaggttcccatttcgggaaggagcatgctgaggcctggagtctggtcacggtcacgtcaccccagggaggcactgagctgggacttggattccagtctctcttgaccaaggcctgccgcgtttccactccgtgacgaggagcgaatgaataaccaggcacttggcgatggtctgcaagtccccagccccgcacctccctgggccccagagcgggtgtctctgaggcttggaacattccaagcagacctggccgggaagccagcctccccctcagagaaggctaaaggctgcacggcccagctctggcgggagaggaaccgtgattgcagcctggctcgtcctttacgga

SEQ ID NO: 44570 - DNA, 781 bp, Homo sapiens
taggtcaactttcattctatgatgcaaattctaaacagttgctatattcctttaagacaaaatttactcagccagtactacctggtttcatggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgact

SEQ ID NO: 44571 - DNA, 423 bp, Homo sapiens
catgagcctccacgcccagcctaaatgtttgattactattgttaggtagttaaactaaccacattgaggaccacctttgggttagcagttcatgaaaactgaaggtgttcctgtcggaaatgggcggtgcttactggaaggctccatcacttatgtctctgagggcattagagttgtctggcaatttataggtttgaagcgttttcatatgtataaaagatatatatgtgtgtgtgtatatatacacacccacacacatgcacttcatatatagaacagatataaatatattacctaggatctaattgtgaaattgtatattttcctatcaatgtttatagacaaggaattgtataaagaatactatccttaaaaatgtctctaagtatagctctaaattatttcaagtccagggattttacc

SEQ ID NO: 44572 - DNA, 719 bp, Homo sapiens
catttttttaaaagactatccccttcatcactgtgctttgtccctttgtctaaagtcggttgttcatatatgtgggtctgttccgtagactttattcagttctattgatcttttttgatatgatgccagtaccatactctgttagtaacgatagtgttttaataatacatcttgaaattaggaagtatagagttattttgcctatagtagatcctttattttgcattttagaatcagcttaagagtttctgcaaaaatacctgcaggaattttgatgggagattgcattgattctctagatcaatttggggagaattttaacaatattgagtattttgacatatgagtgcaatatgcctgtcattcattcaggtctttaatttctctcaggattgatcctttttaaaagtaaacccctttattttggggataattttcatttttttccccccttcatgtcacagtttttcattttatttttccccctcccatgtcacagttttgatcatggaataatttttcaagatctgagagctacagtgaaaaggaaaaaaagaaagaaagaaaacatgatactatagtccctgatgattgattttttttaatcccaatcatctgtaattcttcccagagataagaaatggttgtagtatgttatctcctaggaattttttttggaattcaaacagataaataaaatatactcatagaaacaatgt

SEQ ID NO: 44573 - DNA, 2542 bp, Homo sapiens
gaaagccttccttcatctctatttagttaataatgtgctctctcctcctgttttgaaaccccatagctctctacacctcttattgtacatcactctactttgcattggagttctgtttctatatgtacttattcacctgttgcctaaacatgcactgttcctaaaaggtacagtttttgctcaaaatatatgaaaggaaagataatcagttcttaaagtttggtatgctaaataagcacccagggaacttacctgctccacctcaccccagaaattgattattcaggtctggaatatggctcaggattcttaattttcaaccaacacaatatagaatcctgtcagttatccttggatcatttgctaagtgatcttgcaaaatcaaaactcctttgagactatttcattttcagaaatattttaaaacttgttcagaaacatcttaaaacttgttagcatataggaaaagtacaatgcttggtgtaggtaggttattatttggtcatttccctcaaaccatccagacaagccactcttctaccacaagctggtagaaatccttaggcacctttctgcttctgcactgctatcactttcaggtgtctaaggcttctggaaggctgttgtcataacctggagccatacacctaatgtacgtctgggggaaaggacaccaattaaagaatctagagctaggatgatgttacataagacagggcacaatggagatggactctggatccctgcatctgaaagaaaaaggcaagaaaatgcagggcagggaaaatcctgaaggtcttcactgaccatgaattaaaatcctaattgacagttttacaaacaaaaaccctcgttttagtacttgtgttgtttttgtttctgttttaacaagcttagatttattattgtgccttttatggaagatgaggaagaaataggaaagcagtaaaatgaacaatgagaatctgttacccaaactgatataaactccctcagaaagaaagatactactccctaatcctggaagtgttaagtggcaataatgatcaaatgttgtaaaggggattgttactacagctaatatgaaatgggaggctggactaaatctaacctttctacccttgatttcaattctaaaaggacacgtaataccattgcagaaagaaaaggcagttccaaatgataaattttagagttgttttgctaggatgcaagagaaattggataagtggaccactcatacgttgctggtgagatatgaaatagtagagccactgtggaaaatattcttggcagtttcttataaaactaaacatacatttaacatataactggcatttgtactacttgacagttatccctgagaagttaaaacttaacattcacaaatgttacatagcaccttcatttataatagccaaaacccggaaacaacctggatgtccttcaaaaagagtgaatggtttagtatgtccacaccatggaatactaaatagtaatatgaaggaacaaactactgatacatgtaacaaattgcatggacctcaagggaattatgcttgggtggtttggggggacaatcctaaagttttacacactgtatgattctgtttttgtaacattcttaaataataaagctatagagatgggaaacaagattcgtggttgccaggtcttgggactgaagggaaggagaatgtggctataaagggagccttgtggtggaaaagttctgtagtttgattgtggtgattacataaatatacatgtgaaatgttagaagtatttatagctgaaacatattagtatgttggtatatacatatttctgactaattaatttcgccatgttgcccaggctggtctcgaactcctaagctcaagtgatgtgcccgcctcaacttcccaagtgctgagattacaggcgtgagccaccatgtccggcctgttttttcctatgcatgcataattacgatcaagtttaatttgtaattaggcacattaagagattaacaatagctaacaaaatggaacaattacaacaatatattgtaataaaagttatgcaaatgtggtttctctctctcaaaatatcttgtactcacccttgtgaggctgtgagatgtcatacaatgcctacatgaagagatgaaatgaggtgactgatgtaggtataagtgatgtagttaggctacattatcatcaaaataacttcgggtaatcctggatcactgagccaaggtaatgttgatggttaaggagcagacaatgttgatggttggggatcctcaataggtgaaggatttctattttggggtctttttgctgaaaaattttggaagaacactgtaaccagaagttgttgactcttcagctcatcgaagtgttgctgcagagactgtaatcctttggtgatcatattggtaactttaatgctgtgtctcatctgaggatcgtattctataattctgttgtttaatgtctgtgcaattcaaaacacttcggcaagtttaattaatgtctatgttggctattctgcttca

SEQ ID NO: 44574 - DNA, 420 bp, Homo sapiens
tggggagtgactgcagtgcttcctcgtggagtgaatttcacccactgcagggttgaaatagtagcctgggagccaggatggagttccggagctttcctattgcttgagaaagaggcttctaagaatgtcccttgaggcctggtctttatgggtctgacctggcagctagaccaagaggatctcaatctgggtctgcagggacaagagaggactctgcgtgacaaagggaaggtgggagtcagaacattcagatcctaaaggatgggctcccacaggggaagcagaggcttgtccaccaggggtggaggtggcaggttctgcagtttttctaagccttgaggagaggaaagagtgtggatggcatgtgcccttggttgtctcttcgattcctggggtcatgggaactttcctattcttttt

SEQ ID NO: 44575 - DNA, 803 bp, Homo sapiens
tgtgccaccacgcgtggctgatttttgtatttttagtagagacggagtttcaccacgttggacaggctggtctcgaactcctgacctcaggtaatccgcctgcctcggtctccccaagtgctgggattgcaggcgtgagcctctgcgcccggcatgaagcatctttaagagagtttccattgtttaagttttcagagttgttgaaattccataacattctccttcttggtcttttaaatttggcctgtattctttcctttatgccaaactgcagaatttttcattattctgtatatcagtcagtgccatttcagctgtgccctggtgcgggtcattattgtactagacaattgagttcttataaaatcctgtgagttgttacttttttttgtttttttcagaattcttatgacagatattagacatactgaatccaatcttttccatttttattttggggtgtaacgtattttacggcatcctgtttcatggatgcagtggcatgtttgtgcattaagacttcacaccaattttgacaccctcttctcatctccgtgcagcttagattgtcgcttcacctgcttgctaagtccgatgcacgcctgcattttaccatgcagaaatatgttcaagccactcatcctctcatgtctcttcaccagttcttttgttatgctggcatataccctttgtttttatttatattcaagtttccagacatagcattaatgcctttacttttgtgtttttatttctgtacactgtcttgctgggtctctagagatgacttggctcatctttaa

SEQ ID NO: 44576 - DNA, 431 bp, Homo sapiens
cttgcacttgtacataatatacagcttctcactgctagacaataggtttctaagagtcagggtcatgttcaaataaaacttttggatctgggaagagtgagctcattaagtatttaatcagtggaaaacatatggggagaagaaatttttaaaaaagaaatgtaggccgggcacagtggctcacgcctataatcccagcaccttgggaagccgaggcaggcggatcgcttgaggtcaggaatttgaggccagcctggacaacatggtaaaacctcatctctactaaaaatacagaaattagccaggcatggtgatgcgcacctgtaatcccagctactcaagaggctgaggcaggagaatcacttgaacccgggaggtggaggttgcagtaagcggagatcacaccactgtactccagcccaggtgacagc

SEQ ID NO: 44577 - DNA, 1389 bp, Homo sapiens
tgactgcctaagcaaaggagtctgagaccagcctggctaatacagcaagatcccatctctattttaaagaaaagtttcactttgggaggccaaggcgggtggatcacaaggtcaggagatcgagaccatcctggccgacatagtaaaaccccatctctactaaaaaaaaaaaaaattagccgggcgtggtggcgggcgcctgtagtcccagctactagggaggctgaggcaggagaatggtgtgaaccagggaggcggagcttgcagtgagccgagattgtgccactgcactccagcctggacagaaatgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatgttgttaagcgtattctagatataattcattttggcaaacatactgtagaaattcacataacattttactgtactaaaagtaaattgcccatgtaacaaaaaattatcttttcagagcttgaaatgaattttaaaggatgactgatggtccttggaagagaaacagtaaacaaataaggtttgtagcagtgatgtatgagttagaaattgcagttccagatgatctctttattaaagagacgatctacacttaatttggtcaagtgttatgaacatagttcatgttaagtctccatttaaatacaacctgaaataccaaagttaattttcttttctttctttctttttttttttttttagaaggagtcttgctctgttgcccttcctggagtgcagtgacgtgatcttggctcactgcaacctccacctcctgggcttgagcgatcctactgcctcagccccccaagtagctgggaggacaggcgcaacacggcactcagctaatttttgtatttttcgtagagatagggtttcaccatgttgcccaatttggtctcgaactcctgagctcaagtgatccgcccgccttggcctcccaaagtgctgggattacaggcatgagccaccgtgcctggccagaaaattgtaaacacacacaaactctcaagtggcctaattccctctcaccaaaccaatcacaatacagataaaagagaataacttgtgttcatttttgtacaaacaaaaaagatataaattgtgaatgatgcatgatttttaattacaagtaaactgggcaaatgcttctgcattatttaaagctaaaaggtgatcagtggaaactttcctctgttagtactctaatactttttatatttatcggctcactacaa

SEQ ID NO: 44578 - DNA, 954 bp, Homo sapiens
tgactgcctaagcaaaggagtctgagaccagcctggctaatacagcaagatcccatctctattttaaagaaaagtttcactttgggaggccaaggcgggtggatcacaaggtcaggagatcgagaccatcctggccgacatagtaaaaccccatctctactaaaaaaaaaaaaaattagccgggcgtggtggcgggcgcctgtagtcccagctactagggaggctgaggcaggagaatggtgtgaaccagggaggcggagcttgcagtgagccgagattgtgccactgcactccagcctggacagaaatgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatgttgttaagcgtattctagatataattcattttggcaaacatactgtagaaattcacataacattttactgtactaaaagtaaattgcccatgtaacaaaaaattatcttttcagagcttgaaatgaattttaaaggatgactgatggtccttggaagagaaacagtaaacaaataaggtttgtagcagtgatgtatgagttagaaattgcagttccagatgatctctttattaaagagacgatctacacttaatttggtcaagtgttatgaacatagttcatgttaagtctccatttaaatacaacctgaaataccaaagttaattttcttttctttctttctttttttttttttttagaaggagtcttgctctgttgcccttcctggagtgcagtgagccgggatcgtgccattgcactccagcctggtcaacagagcgagactccgcctcattaa

SEQ ID NO: 44579 - DNA, 910 bp, Homo sapiens
tgactgcctaagcaaaggagtctgagaccagcctggctaatacagcaagatcccatctctattttaaagaaaagtttcactttgggaggccaaggcgggtggatcacaaggtcaggagatcgagaccatcctggccgacatagtaaaaccccatctctactaaaaaaaaaaaaaattagccgggcgtggtggcgggcgcctgtagtcccagctactagggaggctgaggcaggagaatggtgtgaaccagggaggcggagcttgcagtgagccgagattgtgccactgcactccagcctggacagaaatgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatgttgttaagcgtattctagatataattcattttggcaaacatactgtagaaattcacataacattttactgtactaaaagtaaattgcccatgtaacaaaaaattatcttttcagagcttgaaatgaattttaaaggatgactgatggtccttggaagagaaacagtaaacaaataaggtttgtagcagtgatgtatgagttagaaattgcagttccagatgatctctttattaaagagacgatctacacttaatttggtcaagtgttatgaacatagttcatgttaagtctccatttaaatacaacctgaaataccaaagttaattttcttttctttctttctttttttttttttttagaaggagtcttgctctgttgcctccagcctgggtgacagagtgagtctctgtctc

SEQ ID NO: 44580 - DNA, 755 bp, Homo sapiens
tgactgcctaagcaaaggagtctgagaccagcctggctaatacagcaagatcccatctctattttaaagaaaagtttcactttgggaggccaaggcgggtggatcacaaggtcaggagatcgagaccatcctggccgacatagtaaaaccccatctctactaaaaaaaaaaaaaattagccgggcgtggtggcgggcgcctgtagtcccagctactagggaggctgaggcaggagaatggtgtgaaccagggaggcggagcttgcagtgagccgagattgtgccactgcactccagcctggacagaaatgcatttcataatgcattttaattgcattagcagtgatttaatttttttagatgctaaaacttatgggtgaaagtggattaaatgtagccaaatgcaacatcaaaatcttcaggcacaaaaacccattaactttttcatactctcagaaggtgaacctaatttcaaatgaaagctgcctccagaatatgttgttaagcgtattctagatataattcattttggcaaacatactgtagaaattcacataacattttactgtactaaaagtaaattgcccatgtaacaaaaaattatcttttcagagcttgaaatgaattttaaaggatgactgatggtccttggaagagaaacagtaaacaaataaggtatgatctcgtgaaatcttgagagaaactgaatgacgaatgaaactattgttcctgtttcacacagaagaaaactgaggt

SEQ ID NO: 44581 - DNA, 289 bp, Homo sapiens
tattgtgcttgtttcttgattcttcaagtattctgacatctggactggaatacctgccatgcgctggccatgtgctaagcactgagggtcttcagcagtgaataagacagatgtagttcccaccttcatggaagacacagtctatcagagacagacacataaaacagaaactaactgggcttggtggttcacgcatgtaatcccagcactttgggaggctaaggtgggaggatcacttgagcccggggtttcagcaccagactgggaaacatagcaagagtgtttcttt

SEQ ID NO: 44582 - DNA, 662 bp, Homo sapiens
ggaaagttgcagttaaaggaagttatctattgtcagcagaggagggggtcacaaggtgcatggtagggagatcataagactcattgtccagaagaagaatgtcacgaggtcgatcaatcgatcagttggggcagggcagtaacaagtcataatggaacgttgtaaggttggtcaatcagttaagacaggagctggctgtttcacctatttgtagtttttggttgcctcaggccatctggatgtacccatgcaggcttgggctaagaggcctgaaacccaccactttcccatgtcaaatctttagtagatgtacccccaagatacacattcctcggaccttcttttccatagttaaaacttcacccctgaaatgtagaaacaggaaggtttttttttaagtttcagtgcaaactcggagcaagtgtcataattttctgtctccgatgtgtagaggtgacattttctcagaactttcatgttaagctggaaaactggaaagcgagtccactttgtcattctgtcactcactcattttctcactcaacaaacatgcctcacacttatctaaatctgctaggctaaaagaggtccctggtgtctgtaactttctaattctgctagaattctagagtgagctcatgaaataaatgaaaaggatgaag

SEQ ID NO: 44583 - DNA, 467 bp, Homo sapiens
ttcaggttagcagtatgtagtggaaagggcatggactgggtgattaaatacaggctgaaatgttagctccatccttgctgtctatgcatgctataacttggatgtttgacccctccaaatctcctgttgaaagttgatccccagtgttggaggtggggcctaatgggagatgtttgggtcatggggcagattccttgagaatggcttcatactgtccttgtggtaatgagttctcattccattagttcccaagagagctggttgttaaaaagagcctggcacctcccaatcctgatcgcttcctttctttctcatcatgtgatctctgaacacgctggccctccctcaccttacaccatgtgtagaagaagctcaaggctctcaccagaaaacagatgctgtctatgcttcagtctatctacagcctgcagaaccatgagccaaataaacctcttttccttataaat

SEQ ID NO: 44584 - DNA, 820 bp, Homo sapiens
cttagagagattattctaaatgttgtagtataaaagtacatcatccactctgaaatctccctaaaagaactccactgcatacacgtggagaagtcatcatgccccatctgtgtctgtacctgcgggtgtgtctagcatgctccctagggaagggattttataccatttgcttatatttatttggcaagctccatgaaaacaaggactgttttttaactttgtggctgacacttggttgcctaagtgtttaacggtgattgagcggggacgttgacggtacaaacactgattgaatttaccactggagggcaacaagtcaccctgttcaggctgacaatcggttactattcaataattccattcccagaagatacgccaagtatgtttatacaggtggtttcttaaagttctgtttgtgattatctcgtcttgagcaaatgaggaaaggatgtgaagaatctggtgtccccatgatctcacccagaaatggtttggtagttacaaagcaagatagagcagttgagcaaatacttagcccatctagtcctctaccactaccaccttcgccttttaatgagcaggactttgtagtaagcgagttgttgaaaaggagctccacatacttagtaacagcctcggagcggatggaaagaagtaggcattgctgcagagctgagatgaacctgcaaggagacagccttggccccagggaatgatcactgcactgcgccccctactggcctggctgagatgactagctgtgattccctccttagtctcacctgttgaagatggcgcagaacagttacagccatgatca

SEQ ID NO: 44585 - DNA, 497 bp, Homo sapiens
gacttaatcaccctcttccagaatagatagaattcagtaagagtgatggactgtcatttctgtaattaagttaggaaagactactacttcagtcttgctagctttctctttctagtgggcactctttcattccatcttgcctttttgggttgctcacattgatgaagcaagctacaattttggagaaactcatatggctaggaactgaaggtgaaccccagccaattcccagcaaaggactgaggctctcctattgagttaaaaagcccacaaggaactgaagcctgcaaacaaacagaatgagcttggaagcagattcttactcagttgaagcatgaaatgacgatagccctggctgacaccgtgattgtggccttgtgagagatcctgaagctgaggacccagttaagccatgtccacattcctgatccacagaaactgcttgatgtgtaaaccactaaattgaaggggtaatttttttgtgcagcgatatataa

SEQ ID NO: 44586 - DNA, 569 bp, Homo sapiens
tatcctccccaaaattcaggtggtgaaaccttaaccccccaggtaatggtaatagaagctggggcctttggaaggtgattagatcatgagggtagtgccttttaaaagagactcaagataagatagagaccccctcatttcttctgccatgggagaacacagcaagaagtcaccatccgtgaaccagaaagtgggttctcaccagatactgaatctgccagtgccttgaacctagactttccagccagaactgtgagaaatttctattgtttataagccacccagttgatatttagttacagcagcccaaccaagactgtggttatgaggaaacaaacacattattgtggctagactaatggaactgggtcccttacctccaagtacaccctctgtccttttcggtaaaaatatcttcgccaggcacggtgtctcatgcctatgatcccaacactttgggaggccgaggctggagggttgcttgagcccagaagtttgagaccagcctgggcaacactctacaaaaaaaaaaataaataaataaataaataaaataaatcagccaggtg

SEQ ID NO: 44587 - DNA, 1386 bp, Homo sapiens
ctttgctcagctatttctcccactgtccagtgagcggcttgagtgcaggaactgttttattttatgtttgcgccttcttttcatatcttagtaggtgtcagtgactctcaaacagatactctcctgaaggagggtagtgctttcactggcaatgacccaagaccatcatctggggcctgccagagtcaggcacagccccggcattagaactttgggctgtaagcctgtcctctgtgcttatgtgggtggtgcacaaagcacttgcaaacatctgtgtgcagtgctgctccattcggcctgctgaagctttcctgccctgttgccgctgaagcagggagtgtgggaagcgcccagctcagagctgggccagatgtggccatacctcccagcagtgcaagcagcatcactgcgccaggccagctgactcggctggccctggtgcacagtgcttaggggcttgtggccacgagccatgccccaccacctctcctgtttgccttggtagcttcccagcttcctctcacatgactgtttctgtttacttctccctctggccttcctgcctgcggcgtccctgtgccacctagagtctcatctaccgcactagacatagcctctgcaatggccccgcaccagggcctccttccagggcatatcccgtctctgtctcacccttctagtctgcgcttgcccttctcactccccagctctctctgttactgtcagtggagggtctgtgcactttgtcgttttgatcctatgacgttgtatctgtggctcttccttcaagtgcccaggagaggcccagctcctggggccagaaaggggttagtcttgaagtcttgggttggacatttcaccatggccagcccagagctcggctggaaacagatgagagacaacatgtgaggaggcagacaggagctggggatccaggctctgagcacctgagaggtttgggggaaggtattggtaatggattggattgtgtcccccaacaaaagattttcaagtcctaacccctgtacaggtgaatgtgaccttatttggaaatagcgtctttacagaggtaatcaagttaaaatgaggtcatttgggcaggtgcagtggttcatgcctgtaatcccagcactttaggaggctgaggtgggtagatcacttgagtccaggagttcaagaccagcctgggaaacatggtaagaccctgtctctacaaaaaatacaaaaaaattagccattagctgggcatggtggcatgtgcctgtagtcccagttactcaggaggccgaagtgggaggactgcttgagcccaggaggtggaggttgcagtgagtggagactgcaccactgcattccagcctaggcaacagagcgagaccctgtctc

SEQ ID NO: 44588 - DNA, 559 bp, Homo sapiens
aaagttaaattcttggggagaatagaatagaatctaaagagggtgatttttgactccagcatctctcaggtttctgtttacccacctgcaccttctcttctggttctgaggcaggtgcttatctctttggagatgtgctgaggcagaatcagatcaacagctcttgcagagaagacgaagtgaggcgaggttgttaggtctagagtgcagaggggccagattagagtagccctggttggtggaagtatcacagctgcaaggataacctgagtttcctgtgggttaagaataggtcatgtaaggtatctgactgaagccatcttgccaggtctcctgtcaacagtggagcattgttgaacagattatgaggggtaagagaaggacatgaccgtgcttttgctggatcttctgtgtcagggacctgaacaaagttttcctgtctcccctgccaccaccagcagagcagtgaagagcaaccaatatgtcctgagggagctgcttttggaggcctgaaacatagaaggaaccaataaccagcatgtgttagaggaacaaaaac

SEQ ID NO: 44589 - DNA, 448 bp, Homo sapiens
aaaagctgtaaatggctggtgggggaagataagtaagtaggaagaacagattcccagtaaaataaaggaataatacattacatttgctttatttactatccgttgtgagcttctgctcaagtaatttgactagcagtaaaaattacaatgcccaaggtaacttagtaaatttaggtcaatatccaaaaacgggggggagcatggtaacagatctcttaagtagtgatgataatgagccatcaggtaacagactagtagttttcagagttttgattattttgagttaggtttccagataacagtgaagccgtgggaaagggtccattctccagaagaaaaaacagctgtcaggtaaccagctaggtagttggggcttagagtaggagtgggatcccaatggggaaatggaatattattttaaaaatcaagtccaaagtccagtcatacc

SEQ ID NO: 44590 - DNA, 439 bp, Homo sapiens
tactgccccttctttgacttccagaaaattcaaggtagctacagctgtgaaacataatttgagagcctgtgatggatgtctatcatttcctgtttaccattcattctccctgcttctagaaatggccctcattgtttctttggggaatcgctcctccccaccctgcgtcaatatacataaaataaagcctaccctatcccttggctgagggtggagtgggcatttgatctagacctggccaatcggaacaccacctctgtcttcagcgattggttcaaatgaacacctgaattaggtgggcgtggtggtgcacgcctgtggtcccagctacctaggaggctgaggtgggatgatggcttgagcctagaaggcagaggttgcagtgagccaagatcgcaccactgcactctagcctggacgacagagccagactctatct

SEQ ID NO: 44591 - DNA, 392 bp, Homo sapiens
agggttggaagaatacgcaaacgaatgtttggtgtggaagaacgctggaggagtaaacttactatactcacaatttggattacaacatagtttggttaacccagctctggtgaaccaaatgtacaagtattatttccttatggttcatcttataaaatattttataaattggttgctttctttaagctctccacaaatgaaaaatcagtcccaaaaatctataaaagactatttcagcgttaattgaccattaaggaaatacatactaggctgcatgtggtagtcacgcctgtaatccccacactttgggaggctgaggcagacagatagcctgagctcaggagttcgagaccagcctgggtaacttggcaaaaccctgtctctacaaaaaa

SEQ ID NO: 44592 - DNA, 385 bp, Homo sapiens
gacttctatcattatgattaattttgcctaggcttgaatataaatggactcacatagcatgatttcttttgtgtcagactttattcactcattgatatatttgtgagatgcattcttgttgcctgcggtaatagtagttctttttcactgctttgtcattttctactgtatgaatataccaagttagaaatttgactttttgtcagttaatgactattgtgaattaaaatgcattggtcatcttttataagccttttgctggacgtatacactcatttttcttggatatatgttaggttggaccactagaagttgcctttttgttgtggtgagccgagatcggccattgcactccagcctgggcaataagagtgaatccgtctca

SEQ ID NO: 44593 - DNA, 498 bp, Homo sapiens
gacttctatcattatgattaattttgcctaggcttgaatataaatggactcacatagcatgatttcttttgtgtcagactttattcactcattgatatatttgtgagatgcattcttgttgcctgcggtaatagtagttctttttcactgctttgtcattttctactgtatgaatataccaagttagaaatttgactttttgtcagttaatgactattgtgaattaaaatgcattggtcatcttttataagccttttgctggacgtatacactcatttttcttggatatatgttaggttggaccactagaagttgcctttttgttgttttgggagacagtcttgttacctaggctggagtgcaagggtgcgatctcggctcaccaccacctccacctcctgaggcaggagaagcgcttgaacccgggaggcggaggttgtggtgagccgagatcggccattgcactccagcctgggcaataagagtgaatccgtctca

SEQ ID NO: 44594 - DNA, 447 bp, Homo sapiens
ttcgcctgcctcagcctcctgatgtgctggggttacagacgtgagccaccgtgcctggcctcctctatctcccttgtgactgccaaaagtatctctagacattgccagatgtaccctggggacacaattgccacccttcccgccccccacctcccacatttgagaagtgctttaaggcagttgctttcactggctcattttacagctgagaagagtgagttctagagggtgaagggagatcactcactgctccagtcaaaacctaagtaccctgaaggagtcagggacaaactgaggctttcacctgttgatatttgctgtaaaaacgaatttgttcctcaccataggagctaaattatttggtcgctaatttagtttgccaaggcagacggttctggaagggaagctggatgacttagaatgtgggtgtaataaacactgcaaatt

SEQ ID NO: 44595 - DNA, 319 bp, Homo sapiens
gtgaccttgatcaccttgtcttcattctacctggtaacccactggggacccctgtttggaggatccctccattccagccctcataatttaaccagattattcttgaagctggaaagggctgttgggaattctctcttccagcagaaggtagcaaacaaagaacatacttgggggacatatgggaggggcagttacagatatatttaaaaaagcatcagagttgagtaaagatgatacctatcccccagcccctgctgtcttccacctccgagccagctcagtgagcatctagcatggcaggagggacctgccatccctt

SEQ ID NO: 44596 - DNA, 449 bp, Homo sapiens
ttcataaatatgggatggaagtggccacatctcatgcagtcatcttgatctgaaatttttgggtcttgtgtctcctttgatgaccatttgttcctgtatggttcctaaaaatactcacatttttccagtaaaacctgtcttctagattatatattccttttgagttcattattatgaaacccagagttttgctgttatgttagttcttaacagaacctgatgggatctcatccatcagggttcaaggactgtctttctctgatctcacttccaaaaaaccaggtctctagatttcagaccacaggaggatgttgaagaaagtttgcctgtgtggttgatgataacactgagtttattttgtgaatgctgtggagtatttggccatagttgctaggaataatatatggagtccagaattggatgatagtcctagatgaatgcgctgacct

SEQ ID NO: 44597 - DNA, 454 bp, Homo sapiens
gggaaatgccttaaaatcttttgcaggagcccaggccttcgtcgttcactgctctgtgttcagccctgctctttgggaaggtattcaagaacagtctaagatgttgcctgaagaaaaaaaagtggcagtctagtgggacaagggtttaggatttgggatgaaaggaaagtggctgtgattgggtcacgttcaaacatcgagactgttggttcctgcctggcattctccctcccatccctcccctgccgtagcctctctgggtccctgcagaagcttcgctgttcctcgtggttctgcttggtcctgagtgcccccacgagcctctccatggttccccattgtccacagaggaagctgctctggccggccccgtcctccagcccttgtctccttttcagagccacccatgctctcaccttttccgtgtaataaataataaacacctctagtgctg

SEQ ID NO: 44598 - DNA, 409 bp, Homo sapiens
tgttggcctggctggtctgaaactcctgacctcagatgatccacccatctcagcctcccaaagtgctgggattacaggcatgagccaccgcgcctggcctagagttgtttatatcaacacaggtaagcaagagaaagcagtttgagtaaccggcgacaagaatcagaaaggattaggtaaaactactttgttttttcagatgatacgattttgcgtctgacaaacacaaaagaatcagtggagataaatattgattaaaaagaactgttggcccatgcttgtagtcccagcacttcgggagggtagggcaggaggatcacttgaggccaggagtttgagaccaacctggacaaacatagcgagactctgtctctacaaaaaaaaaaaaaaaaaaagaaaaaagcccggg

SEQ ID NO: 44599 - DNA, 270 bp, Homo sapiens
caggccggtagcactttgtttcagagaactgtactctaatatttacaataatgagattttggttatgatattaattatagtaccaaactaaaaactccgtatttgggtgtattaacccatctctgggaagtagaggtttagtgtctattactcttccagacagcgtggtccacttggttcttgctgctctctttctggagtccagctcccagtctgtccttgcttacctcctacaagagtggacattaattgggtgaaaacattgttttc

SEQ ID NO: 44600 - DNA, 345 bp, Homo sapiens
ctcccgagtagctgggattacaggcatgcaccaccaccccggctaattttgtatttttttagtagagacagggtttctccatgttggtcaggctggtctcgaactcccgacctcaggtgatccacccacctcggcctcccaaagtgctgacattgcagacgtgagccaccgcaccccgcctgttttacctaaccttcacatggacaatgcactcaagctggtacaaaattcaaaaggtatagaagggtgcatgtagtgaaaagggaacctatccattccccacctcatggataacaatgacagcctcattttaagtacatttagaacaaataaatgaaaggaaat

SEQ ID NO: 44601 - DNA, 728 bp, Homo sapiens
tgagatctgcctttcaagacattaatatgaccgtttttatcaaatattttactaaggcataaaatggtcatcacctttctaatctgtaatatcggtattcgtacctccctatcctcttactaagccagtgctacatgttttaggtttgttatggtagcaccctacttttaataacaaattttgtatattcaaggtctagttgaagggaacaaaattcactctagcgagtttatgcacaaaggtatttgcacacaataagtattaaacggcttacagaatcattaggacagttgaaaagacaggctttaagttaagttttcaggaatgattttgagaggtttgcctcaaaccagatcaccaaagatgctcccagctattctatcatgaagctaacagctgaattggaatctatcatgaaagctgtcctctctagaaccgtgctgtcactgccaatattggaaaccctgtatagaaaaaccaaggtgatatttagcatcagaaatagtggaatggtaatgcttctgccttatttacacttcccagatcttgcatgtaattgccttattttaaatctgatccagaacactaactaagaaatgtagggttactttattagcattcttgtttctgcacatcagggaggtacaccagaatgtggttgtgcatgccagtctagcatgttcactacacttttgggaagtcccagttgttccaattagaagtctgtc

SEQ ID NO: 44602 - DNA, 340 bp, Homo sapiens
atctgcagcttagtaactaagcaacctcgggaaacgtagagtgtagctctgactgtgaggagtttcagtttcctcttgtagatagtgttttaacctggaatgctggatttggagccagctggggttgttgattcttttcttgcttggtgctcacatctccaggggctgcaaattcaagtgctggtggcaagacaagagggaatggtggggactccagtaactggagaccactgagctggtcataccagctaccaaaagccatggtggcacatctcttcccagctctgcattcagtgactttgggttggcggcatgaaatcacgagcgtttatactacagg

SEQ ID NO: 44603 - DNA, 298 bp, Homo sapiens
ctgagatcatattaatgatactgagtttaaatttttaaaatttaaccaagtaagtatacttacatcagcaggatatacatctacatactaactttaatcctaatgtatgaaacactatatagaatttaatatatatgacatagaattgtatgcatttattatagcatgatgtaacgagtcccaagttgatggattttcactactataaacatgcttgaatgttattttgtatgtttgtgcaaccctctccttgaaatcaattggtgcaattagagttattcagccaaaacgtatatat

SEQ ID NO: 44604 - DNA, 154 bp, Homo sapiens
gacaccaggcttcctagcaggaagggggtctgctgttccggagaccttgaaggaattggcgctcaggctgcttgggaacactccattaactcgaattgcaaatttcctcctggctctatctctaagccacaggggctccctggccaccagcttc

SEQ ID NO: 44605 - DNA, 468 bp, Homo sapiens
gggtcatggggcatcattttgctttttctgtgtactttgtgtatgtctgaaatttgcatggtagaatttgaagaagcagctaataaaattcttgccttcttctaatcctttacctctatccagtgctgttttttaacttgtgagttgaagatattccagcaaggcataatagaaataagaaaggggaagccaagggaagcagaaagagagagggagaaagagagagagattagtggtgcttgttttaatgactgtgtcctccagaaacaagtcctaattttaacaacggggcatgacttgattggttttgtgcaaagattcaagtttcttctttgataatggttctcattttaggatactgtgccccaggcactatgctgggtgctttatatgcgtaacttatttaatcctctcggttatttttattatcatcagcatccccgttttcaatatgaggactgagattca

SEQ ID NO: 44606 - DNA, 221 bp, Homo sapiens
tgttgtcccaaagaacagctccagactgatttactgaggaaaggaaacgtttcttccctgtgaggccctaaatgcaacctgagttgaaagaggcagagatgggcaagcgacaggcagcctcggaggagccgttgtgcaggtgccacctgtgagctgctcctggctaatgcaccactctcgtccctgggttatgggggttaatgagctacggcttcagcgca

SEQ ID NO: 44607 - DNA, 1004 bp, Homo sapiens
cagggatcctggagagattatcagagttgttggttaaaaatgttaatgttaatccacgacgctctcaagagctcacgtctggtgtgactatgaccatgtcatgctgtttcaccagttagtacctctgctgagtccattctttctgcctggaatgctctttctactcttctatgccaggttatctcctattcacagttagcaattagcctaagacacattatttatttaccttagtttgtgtcaagcatagacagttgtggttttacagatagggaagccaaaccaaacttcctagcctacttttctttttctaatctagtggattttatactgacttacaagattttactgtgagcagcaatgcaacataacccaatatatctaatctttcagatttagtgaacatttagatttttaaaattataattaaagctataacatttagtcttcattttctctgcagaccacaaagacttctgacattctaagttttttttaaaaaataattcagtagattgttatcataatttttactagactattattaaaatattatttcagaaattcatatgttgatgagatatcctgcgttccccatgtatgttgaagcaccattcacaataaccaagataaagactcagcctaagtgtccatcaacagatgaatggataaggaaaatgtggtatatatgaccaggcatggtggcttatacctgtaatcccagcactttaggaggctgggaatttagaagtgggagaattgctcaaggagggtttgagaccagcctgggcaacaaagtgagaccccacctctacaaaaaaataaaaattagccaggcatggtggtgtgcgcctatagtcccagctacttgggaggctgaggtgagaagatttcatgagcccaggagttcaaggctatagtgagctatgaatgcacctctgcattccagcctgggtgacagaggggagagaccctatcccagaaagaaagagaaaaggagagag

SEQ ID NO: 44608 - DNA, 273 bp, Homo sapiens
ccctttcagagagtggggcaagtgacacagttttggcccatgagatgaaaacacacatttactgaatagagtttctggaaaagctatcagtttcctgataaaaagggacagacttagctgtccctttgtcctccctgccttgtctggaatgtagacaggatgcctagacgtggaggagcaatcttaaaagtgtgaagacaaaagccactttctaaggatggtggagcagaaaggcaggagtcctgctccctggcaccatcatggagcatgccc

SEQ ID NO: 44609 - DNA, 1148 bp, Homo sapiens
gctgactgcatcctcaacctctcaggctcaagcagtcctcccacctcagcctcccaggtggctgagactgtacgtgcttgccacaatgcccaactaataatttggacttttcctatacatgggttccaaagggctgactgcgaaacgaagtgacctcacaatgactcaagctaccacttagtgttgattgtgatgaaatgccagctgtggcatatgccttgggagctaagtggctgctgcacttgaccactatgaagactggtgtggaagggtccttctggatgtacttgggcagggtccccaacgccagagccatggaactgtaaggagccacacagccggaggtgaatggtgttgaatgagggaagcttcatctgtgtttacagccactccccattgctcacattcctgcctgagctctgccttctctcagatcagcagcagcattagattctcataggagcatgcaccccattgtgaaccatgcatgtgagggatctacgttgcgctgtccctatgagaatctaatgcctgatgctctgtcactttctccaatattatcttcaagtgagccactcctggcccaattcctgtctcccgttggcctatagaggccaagcctctgcctcatgatggcctctgcaggtcaagctcctcctcctggttccgtctacaggcccaacacttccctcaaataaactcttctgcccagctcctgtccagctcacggcagccactgtcggcatgaaaattcctcaattcaagctctctaggcccaccttctgcctcccactggcctggacacgcccagctccaacctgacaatggtctctacaggcccagctcatcgggctctgagggacctctccaggccaagctcttacctcacggaggcttctccaggtcgtttctccctgtcttcaggcagtggtgacaggtcagctcctcctccacagtggcctcgtttgggcaggtcctgcctcttgcagcctctcaaagcccagctcctgcctctgagtggcttctgcgcacccaaatgtcctccagtcagcctgtcctggctgagctcctgcgacctggctgagctcctgcctcctgtcggcctctataaacccagcctctgctgtatggtggcttcttcaggccca

SEQ ID NO: 44610 - DNA, 343 bp, Homo sapiens
ccagtcacagagatcacatattacaagatcccctgtataggaatgtctagactaggcaaatcttactatgaacccagctactaagaggggaggatcacgcccatgggaggccaaggtgggaggatcatgaggtcaggagttcgagaccatcctgggtaacacggtgacaccccgtctctactaaaaatacaaaaaatcagctgggcatggtggcacgcgcctgtagtcccagctgctctggaggctgaggcaggagaatcacttgagtccagagtttgaagttatagagagctgtgatcaagctactgcattccagcctgggccacagagaccctatctccaa

SEQ ID NO: 44611 - DNA, 517 bp, Homo sapiens
catcctgcccttttaaaaaatttccttttattaaacaaattaagttcatgtatagtctcaataaagcgtttgcaaatccattatatgctccttgaccaaaatacagattacatgtgcacttagaaagaattttttttcttctaatagagtaatctaaaagtctaaccttctccatttttaaaagctttagccaattatttagtaagcattggtttgaaatacattcatgacatttcatagaggagttatttcttctctggtatctgtgaaggtttctttatatctattacatcaaatagtaagacttcaaattattgccgctatgaagatacatcagtattttaatgaactggccaggttttttcccttaataagcaatgagtaaaataatttattttgaaaactcactacatttatctctttctttaatacggaagaataatgccctgcacacctgccttagactaacttgaatctttgttatacatcaaccataaagagttatgttattttgggc

SEQ ID NO: 44612 - DNA, 435 bp, Homo sapiens
tgttccaggcaaaaggaaaagcatgtaatggcctgaaggtaaaggaatatggttcaaggaactggaagaagtgcagaatggtaaggggctcagagatgatggggagaggtaggcaggggagagagcatgcccagctgcgaaagccatcctaaggagtttggactcttttgaaggcacaggagttgaaaaggggagcagaaataagataggggtgatgttttagaagaaatactctgactctagtgtggaagatgggtgagaaggaggcacagctggacacgaagagaccattggacatctcttacgatcctatgtggctaagagctgataatggcctgcagtggagaaaagccaggtatagaaaggagtgagcagattctacaactttctaagaggcagaatcataagtactgggtgattaactgggtatgggga

SEQ ID NO: 44613 - DNA, 469 bp, Homo sapiens
atgatgtttaggtaacacagaaaggcgaattaaaaaaattaaatccaaaagattaggctgggcgcagtggctcacacctgtaatcccagcagtttgggaggctgaggcaggtggatcacttgaggtcaggagttcgagaacagcctagtcaatatggtgaaatccaaggcggggcatggtggctcacgcctgtaatcccagcactggcctaaaactcttcctttaagcacagagttaccataggattcagcaattcccctcatatgcatacatgcacaaaacatatgtccacataaaaatttgtacacaaatgtctttagcagcactactcacaatagtcaaaaagtataagcaatccaaatatccatcaactgatgaatggataaacaaaatgtggtatagccctacaatggaatattattcagccataaaaaggaatggagaaataacacgttacaacatgaatgaa

SEQ ID NO: 44614 - DNA, 368 bp, Homo sapiens
aatcaaagccacaatgagatgccacttgatacccattagaatgaatagtatcaaaaaaaaaagaaaaaagaaaacaacatgttggcttaactatggagaaattggaacccttgtgcattgttggtggggatataaaatggtgtagtggctgttgaaaacccaatgatggtttcttaaaaaattaaacagaataacaaatggtcaagcaatttcactctgggtatatacccaaaagaactgaaagaaggggccaggcgtagtgtctcacacctgtaatccaaggattttgggaagccaagacgagcggattgcttgagtccaggtgttcaagaccatcctgggcaacatggtaaaacctcatttctacc

SEQ ID NO: 44615 - DNA, 330 bp, Homo sapiens
gcgggagcagggagagcttgctatttcccaaagaaatggacacaattaaaaggtaataaaaattactcaagaaagaattcctaatccagaatagaccctcccatggaattgttcctagaacagcaaaggaggcaagctgtccctatcagagtttctgacccacattaaacaaagctctgtctgaacacaggggtttggggctcttctccatttcattgttcttgtcatgcttttctcataaaagtaatttttctgttgaagatgcaggcttcctctttatgcgcaaatggaaatgctctgagcagtacttattctacctgaacatagagg

SEQ ID NO: 44616 - DNA, 464 bp, Homo sapiens
agccaccgcgtctggctgaaaagcactttcaatgagactgtgttgaataaagggccaaggttcttgccacccagcactcatgggggctctctcccctagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44617 - DNA, 1453 bp, Homo sapiens
gccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgaggggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44618 - DNA, 1402 bp, Homo sapiens
  misc_feature (18)..(18): n is a, c, g, or t
  misc_feature (22)..(22): n is a, c, g, or t
tcaggctggtaccggccnggangtatggatgccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgaggggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44619 - DNA, 1353 bp, Homo sapiens
gccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgaggggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaatccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44620 - DNA, 829 bp, Homo sapiens
cagcttgagaccagctgcaggggctcacacatataatccagtactttgggaggccaaggctggagggtcacttgagctcaggagttcaagtccagcctgggcaacatagcaagaccccatctctaccaaaaaaaaattttttttaaatagctggacatggtagtccatgcctgtagtccgagctacttggtaggctgaggcaggaaggattctgtgagcttgggagttcgaggttgtggtgagctatgattgcgttactgcacccagcctggccaatagaatgagaccctgtctctacaataaaagcagtaaaaagaaataaaaatgtaaaaaataaaaatctctcttgagaagttcaacttttgctcttctcccagatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44621 - DNA, 318 bp, Homo sapiens
gcactgtggtcaggatgtataggagaccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44622 - DNA, 1381 bp, Homo sapiens
gccgggccacttgtcttcatgtctgccagggggaggtgggaaggaggtgggaggagggcgtgcagaggcagtctgggcttggccagagctcagggtgctgagcgtgtgaccagcagtgagcagaggccggccatggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgaggggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagaccccccagcaaacagagagccacacccatccacaccgccaccaccaagcagccgctgagacggacggttccatgccagctgcctggaggaggaacagacccctttagtcctcatcccttagatcctggagggcacggatcacatcctgggaagaaggcatctggaggataagcaaagccaccccgacacccaatcttggaagccctgagtaggcagggccagggtaggtgggggccgggagggacccaggtgtgaacggatgaataaagttcaactgcaactgaaaaaaaaa

SEQ ID NO: 44623 - DNA, 2420 bp, Homo sapiens
  misc_feature (961)..(961): n is a, c, g, or t
ttaattaattagtcttaagcaccaggaaagcagttggccctgttctccgcctacaagccttgggaacctgaattgattttttgaatgatccatttttagaactcgagagaagccccagaatgtcacagcttcagcgtcatctggttggctggttttccggcttgttggcctgagtctgtgaggtctcttccagctggcaagggagggaaaccagttcagactggctggagcagagagagggaagggattggttcacatcacaggtcaaggccagctagaatggggccagctccaggatgaggacactgccccccaccagggctgtagggcaggttgatggccaacaccagggcacactctgggatgcacctgattagtgggtgcaggtgttcccactgggtgtgggcagaggaatggggtagttaacagtcacaaatctgtccaggcacagtggctcatgcctgtaataccagcactttgggaggctgaggcaggtggatcaagaagtcaggagatcgagaccatcctggctaacatggtgacaccccgtctctactaaaaataccaaaaaaaaaaaaaaattagctgggtgcagtggtgggcacctgtagtcccagctactctggaggcagaggcaggacaatggcgtgaacctggaaggcggagtttgcagtgagccgagatcacgccactgcactccagcctgggcaacagagcgagactccatctcaaaaaaaaaaagtcacgattctgtgaatactcagttctgagttcgaatcttacctctgtgctcacactgctagcagaatgaccgggtaaatccctgtgcctctgtttcctcctcggtaaaatgggcttgatgctggccgggcatggtggctcacacctgtaatcccagcactttgtgaggccgaggtgggcagatcacctgaggtcaggagttcgagaccagcctggccancatgatgaaaccctgtctctactaaaaatacaaaaattagccaggaacgatgtcatgtgcatgtaatcccagctactcagaaggctgaatgaggcaggagaatcgcttgaacctgggaggcagaggttgcagtgagctgggattgcgccactgtactccagcctgagccacacagcaagaatccgtctcataaaaaaaagggctgatgctgtccacttccaggccccattatagagatgcagtagagatcaggtgtgtcctgtacctggcactgggtctgatgcttaggaggccttcattcagtgacttgagagtgcttttttttggtggttatcaaataacaatagtgaacattcatgaagcagcagctacatgccaggcttctatgtctattgcctggctcagtgcccctaacaactctgtgaggtagatcctaatatctccattttacagctgaggacataaggcacagagaggttaagtaacttatccaaggccacacagctggtaagtcaagaagcagattccagacttgactccagaatcttatttgtaatcactgtagtacatggccttccagttctgctcaagagatagtggaacagttaaattacagactcagacaaaaaaaatcaaaaattaaaaaaaaatttaaaaacaacaaaaaataaaaagtatagactcagctagctgctgtaataaaaacaaagagatcccagggtagagtaatttaaataaaaaggacgtttagtccggagggtcctccaaggacccaggtaagttcttccagccccaaaatgagtttccagctctgggactgaggccgctgcaccagcagccatcatttcccaatcaggaagaagtggggaaagagtaggggacaagcaacaactctttgtaaaggcgtcacccagagatggtacagagcacttctgcttatatcccattggccggagcatggtcacataaccatctctagctgcaagagagtctgggaaatgtagtctctggctgggtggccatgtgcagtgctcatactcttaggggtttggttaccaagaacgaaacagggaggatggattctaagggagaagtaacagcctctgccacaatcaggattcttctctgagatccaggctgggcctggagtccctgggaggatagaaattggaggtctgggctgggcgcagtggctcacacctggaatcccagcactttgggaggccaaggccagtggatcacctgaggtgaggagtttgagaccagcctggccaacatggtgaaaccccatctctcctgaaaatacataaactacccaggcgtggtgctgcatgcctatagtcccagctactcaggaggctgaggcaggagaatcacttgaacccaggaggcagaggttgcagtagccaagattgcctcatggcccttcagcctaggtgacagagtgagactctgtctc

SEQ ID NO: 44624 - DNA, 2362 bp, Homo sapiens
  misc_feature (903)..(903): n is a, c, g, or t
ttaattaattagtcttaagcaccaggaaagcagttggccctgttctccgcctacaagccttgggaacctgaattgattttttgaatgatccatttttagaactcgagagaagccccagaatgtcacagcttcagcgtcatctggttggctggttttccggcttgttggcctgagtctgtgaggtctcttccagctggcaagggagggaaaccagttcagactggctggagcagagagagggaagggattggttcacatcacaggtcaaggccagctagaatggggccagctccaggatgaggacactgccccccaccagggctgtagggcaggttgatggccaacaccagggcacactctgggatgcacctgattagtgggtgcaggtgttcccactgggtgtgggcagaggaatggggtagttaacagtcacaaatctgtccaggcacagtggctcatgcctgtaataccagcactttgggaggctgaggcaggtggatcaagaagtcaggagatcgagaccatcctggctaacatggtgacaccccgtctctactaaaaataccaaaaaaaaaaaaaaattagctgggtgcagtggtgggcacctgtagtcccagctactctggaggcagaggcaggacaatggcgtgaacctggaaggcggagtttgcagtgagccgagatcacgccactgcactccagcctgggcaacagagcgagactccatctcaaatcacactgctagcagaatgaccgggtaaatccctgtgcctctgtttcctcctcggtaaaatgggcttgatgctggccgggcatggtggctcacacctgtaatcccagcactttgtgaggccgaggtgggcagatcacctgaggtcaggagttcgagaccagcctggccancatgatgaaaccctgtctctactaaaaatacaaaaattagccaggaacgatgtcatgtgcatgtaatcccagctactcagaaggctgaatgaggcaggagaatcgcttgaacctgggaggcagaggttgcagtgagctgggattgcgccactgtactccagcctgagccacacagcaagaatccgtctcataaaaaaaagggctgatgctgtccacttccaggccccattatagagatgcagtagagatcaggtgtgtcctgtacctggcactgggtctgatgcttaggaggccttcattcagtgacttgagagtgcttttttttggtggttatcaaataacaatagtgaacattcatgaagcagcagctacatgccaggcttctatgtctattgcctggctcagtgcccctaacaactctgtgaggtagatcctaatatctccattttacagctgaggacataaggcacagagaggttaagtaacttatccaaggccacacagctggtaagtcaagaagcagattccagacttgactccagaatcttatttgtaatcactgtagtacatggccttccagttctgctcaagagatagtggaacagttaaattacagactcagacaaaaaaaatcaaaaattaaaaaaaaatttaaaaacaacaaaaaataaaaagtatagactcagctagctgctgtaataaaaacaaagagatcccagggtagagtaatttaaataaaaaggacgtttagtccggagggtcctccaaggacccaggtaagttcttccagccccaaaatgagtttccagctctgggactgaggccgctgcaccagcagccatcatttcccaatcaggaagaagtggggaaagagtaggggacaagcaacaactctttgtaaaggcgtcacccagagatggtacagagcacttctgcttatatcccattggccggagcatggtcacataaccatctctagctgcaagagagtctgggaaatgtagtctctggctgggtggccatgtgcagtgctcatactcttaggggtttggttaccaagaacgaaacagggaggatggattctaagggagaagtaacagcctctgccacaatcaggattcttctctgagatccaggctgggcctggagtccctgggaggatagaaattggaggtctgggctgggcgcagtggctcacacctggaatcccagcactttgggaggccaaggccagtggatcacctgaggtgaggagtttgagaccagcctggccaacatggtgaaaccccatctctcctgaaaatacataaactacccaggcgtggtgctgcatgcctatagtcccagctactcaggaggctgaggcaggagaatcacttgaacccaggaggcagaggttgcagtagccaagattgcctcatggcccttcagcctaggtgacagagtgagactctgtctc

SEQ ID NO: 44625 - DNA, 842 bp, Homo sapiens
tggcacgaggaggggcggggcgatagggatccagagtcttggggatccagagtcttggggctccatgtgagtttgctgtaccggttgtcccggtcacggcatggggcgagcggacactccacgacaccccccgcccccggctgcagggtttggggtccaccggggcgcatttctgatcccagtggctcttcgggtgctcttggccggaagaactcccagacctttcactcctggcctggccgatccacgaagactcgggccccggcgcgtccaagcagcacaatgagtagttcttgacccgaggtcgccctgaaggtgtcgcatgaagagcttgcttcacacacaacaggattcgatactttgccaattcaaggccctggtggctggccgggaaggtggattcgccttggctaggtgccaggcaggtccgcctgtgcgggtgcccctgacttcgacccctagcttatgtcacagcccgaaccagatcgactggtctggtagcagcctgtcactccagactgtcctccaccccagacttccgcaaactgatgggctctttgcgccgtgcagggtgggaggagaagaccaaacgaagtaacgtctgtaaaaccccttcctggacagcgtaaggcctccacatctaagttcctgtcattaaaatggagacagcaaagccgaccctatccagtccttgggactgttatgaacagaaaatgatgcaatgtatgaaaaactgctttgaggagaaaaacaacacagtgtgtttttggaagatgtgattgatttgtaaaccgcattaaatgctctgaaataaaatgaaagtaaaaataagtaaaaaaagg

SEQ ID NO: 44626 - DNA, 437 bp, Homo sapiens
gcacttcatcccatttagttattcaacattctgtgaaatatgtttcattatcaccacttacaaacaagggaagtgatatttcaaaatccaggttcttaactgcccatatgttattattctaatcctaatcttacctaatatagaggttgggttggattaatttctagggttccttcagacccaagaaataattctttttttttttttttttttttttatatggggtctagctctgttgccagactggagtgcaatggcgtgatctctgctcactgcaacctccgcctcccaggttcaagcgattctcccgcctcagcctccagagtagctgggattacaggcacacgccaccacacccagttaattttgtttgtttttgtggttgtagtagagatggggtttcaccatgttggccaggatggtctcgatctcctgac

SEQ ID NO: 44627 - DNA, 295 bp, Homo sapiens
atatatatgcaaatcttccaaaatctgaaaaaatttaaaatccaaacacttctgtccccaagcattttggataagaaatatttaacctgtatactattttcctgcatgtgtttctataccttttgtctgaaagacagatgtaccagagtatgaggtaactttttgggaggatatcacataaaatctaaccaatctcaattcttcttagccccaaaagatagaaacaattgcatgataatgcaatcatagtgcctgagctggaatttgtctataaaacaaaagcaaaccataaaca

SEQ ID NO: 44628 - DNA, 454 bp, Homo sapiens
agagggagggctgagggataaacgactgaaaattgggttcagtgtaaactgctcgggtgatacgtgcaccaaaatctcacaaatcaccaataaagaacttactcatgtaaccaaataccacctgttccaccaaaaaccaatggaaattttaaaaattattaaaaaataaaaaagaatgaagtgtgcttacgagatccagaaaattgcctcaagtaggggaaaaaaaaacccacagagttacttgctttacagaggatgtagagagatcagggtagaatgtttattcaaataaataataacaaaaagtgtttcaaaccttgagaaaaaatataaatatccaaatacaagaatgttaaagaacaccaagaagactcaaactaagtaagatgactgcaaggcatataataatcaagctcacaaaagtcaaggacaaataaaggatcctaaagtcggc

SEQ ID NO: 44629 - DNA, 457 bp, Homo sapiens
gttcactctaacagccttattttaattcagtcacttcttcaaaaggccttgtttctaagtctcaatcactttctgaggtactggagatgagagtttcaacatgtcagtaatttttgggggatcacggtttcagcccataacaatactgtaaagtttttcttgtactgaagacacagaaaataactttactctaaagtgctaatgatttattaactaacacaggtagaatatcccttatctgaaatgcttgggaccagaagtagttcagatttttttggattttggaatgttcatattatatttcatggtataatatctctaatccaaaagtctgaaatccaaaatgctccagtgaacatttagtttgagagtcatgttgatgctcaaatggtttaaaattttggattagggatactcaacctgaaaattttgaaccttgtttttttaaactaaaaaa

SEQ ID NO: 44630 - DNA, 285 bp, Homo sapiens
gacttatatggctgcagttctcaagtttgtgaggtatggttagaacaacagatgagcacatggttcagtggtacagggtagaaaatgcagaaatagagccacacaattatgcacacctaattttgacaaagatgcaagagcagctattcagtagaggaaagacagcctttcaacagtgacgctggagcaaatggacatccataggcaagaacccaaccttggtgaagatctcacaccttgtataaatactagctcaaaatacatcacaggcttaaatgtaaaatg

SEQ ID NO: 44631 - DNA, 558 bp, Homo sapiens
tattagagtatttcaaagagataaagaatgttgtgtcagaaagcttgagggtgtatgtgaagtcacagagcccagtagccaggatgtagacccagtcttcccaaattcaaacctctgctcctaccttcacacaacatccacctccatggtgtcttgacagggaacgggagacgtgtgttgattaggtcaatgtagtaggagattcattttatttctgttcagaagttcagagaaagtcagatttgtttttgatcaaataatgaaagagaaagggtcttaaagaaaaagttggctaggtacagggctcacacctgtaatcccagcactttgggaggctgtggcaagaggattgcttgagaccaacctgagcaacatatggagacaccgcctctgcaaaaattaaaaacctagctgggcgtgatggcatgcacctgtagtcccagctacttgggaggctgaggtgcaaggatcacttgggcccaggaagtcgaggctgcagtgagccatgaatcgtgccactgcactgcaccctgggcgacagaagcagactccgtctca

SEQ ID NO: 44632 - DNA, 301 bp, Homo sapiens
atatctattgttgtatcctcccacccattttccatagaggagctagagtcgactggtcctaaaatgcaaatctaggctcttcactcccctgcgtaatcccccttgcatttacaaagatcccagtccttccctctgatgtcctctctgacttggcctcctggcttctctggcttcacggcatcccactcgcccttactaggcacgcttttcataaatgcgccagcttcgctctcccttctgggtcttaggcccttctcccacctccatccacacacttcaggacataaaaaaatcctaggca

SEQ ID NO: 44633 - DNA, 754 bp, Homo sapiens
cagccttttagcatttctaagctggactaggcgagagtgtcacacctgcttcccttggcttccatcttgcctcttccagtttatttctcaagctgcagtcaaactgatcttagaaaacacgaatctaatcatgcagcacccctgactaaggtcttccggtggctgttcagagcctcttgggtagcaaacagatggcttctgttgtatacaaagccccttaagagaggtctcctcatctactttttctagcctcttctctcccaactctgtattctcctgtaacactgactgagcactgcaggcttctgccctttgcacatagtaagcatgcatttctctctgtctgaaatgctctttctgttgttcatctagaagactgttttcccttgaagactcagccctagcatcacctcttctgtgaagtcttctgctactttcccaagcagagtgagtgttccttcccttgtctgagtggccttggccattgatgtgcttatcatgttgtcttacgtatcaaattatttgttgtcatatctgtccccttcaccatactgtgagctccaaagaaaagaagtgatctttatacttcttatgcttagtacacaactagacatatagtgtgtgtgtgagagagagaattttttaatgaaataattgaatacattggaagtgtttcattcaaaatactcatccattattctttggatagtagcataaatttgatgttttatgtacaaaagtaaaaacatttgaa

SEQ ID NO: 44634 - DNA, 625 bp, Homo sapiens
ataagcaaggcttactaataaccctgcatattcctgttgctcccttcttcttgggtttctagattgcgttttggaaagttttacctcattgacttacaaatacagaaataagtgattcttcagaatagggatttggatcaggagcagcagggagtgctcattaaaagggcagattccagactctcacccctgcagattctcattcagtaggtctgaggtgggttgtgagcatctgtagtttaaaggcatcctgggtgattttgaggacttctggttgagaactgctttaatgcatcattcagcctgctagccagtcagtcagcaaatgccaggcatcatctctgtaccactaccctgccctgagagggcagacagggcaagacccacccccgccctccgctggctacactttgttactggtgactattactcaccccttttgaaataggcgtcatttctcccttagcctttcaaaatgaatccttctatactgggaaggttatagacttgccagatctctgagcaggaaaagatccaagaaatcaaatccagccacactgccagtccagcccctcctacagctggggcaatgccccccccgcccccccccctccgccgcaaaaaa

SEQ ID NO: 44635 - DNA, 246 bp, Homo sapiens
ctacttgctgcattactactaatgaagtaagttgagtgattttttttttaaaaagaggtctgcttgcctgggcatggtggctcacacctgtaatcccagcactttgcaagcccaaggtgggcaaaccacctgaggttaggagttcgagaccagcctggccaacatggtgaaaccccatctctactaaaaatacaaaaattagctgggcgggatggcgcatgtctgtaatcccagctatttgggagg

SEQ ID NO: 44636 - DNA, 423 bp, Homo sapiens
ccccatggttgagtggagcaccttctgtgcagggtgacagggctgggaggggacaggggaagagtgtgtggggtgaggcggcttctgggctcctgatcagtctctggggtggctgtcttcgtggatttcctttgaggtgtggggcccaagctgatcctggcctcactattggaatgagggtctcagggtgggtgtggtaccatgtaaaggtgccagcaagtcctcacaggtagggatggcctggctcctgacaggtagacccctgaggtgcaggaagcctcttctttgagaccagcaggctggtctccccaaggaggtctgaggagcagccatgtcagacccggctctgttccgagcctgcagccagagggcaggtcccacgttccaggccttcttccctcctggcccctgtcctcagtgttg

SEQ ID NO: 44637 - DNA, 1661 bp, Homo sapiens
attgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggcttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattctaaaaatggtgaatattattaatattgtataataggagtgggaagactgcctccttttttgaagagagagattaaggatttttataattgtttttcatcaaattttaatatttttgtcaaatttttaggtatttaatttgtaaaacagtttgctttgtactggcatacagaaaatagggtattgattttaaactttttgaagccaagtgatcaagtacatttgtaataaaagtcaatggatctata

SEQ ID NO: 44638 - DNA, 1376 bp, Homo sapiens
  misc_feature (1227)..(1227): n is a, c, g, or t
  misc_feature (1234)..(1234): n is a, c, g, or t
  misc_feature (1246)..(1246): n is a, c, g, or t
  misc_feature (1251)..(1251): n is a, c, g, or t
  misc_feature (1259)..(1260): n is a, c, g, or t
  misc_feature (1262)..(1262): n is a, c, g, or t
  misc_feature (1269)..(1269): n is a, c, g, or t
  misc_feature (1271)..(1271): n is a, c, g, or t
attgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggcttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgatatngtggaanacttttcttcantttgnatttaatnngnttggtcnangagtggtttgggcatgggtcacagggttaattatcgttgggccaaaatcctaagggtattgtaaggggcgaagagatgtaatgttagatagataataagagtgcg

SEQ ID NO: 44639 - DNA, 1978 bp, Homo sapiens
attgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggcttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattctaaaaatggtgaatattattaatattgtataataggagtgggaagactgcctccttttttgaagagagagattaaggatttttataattgtttttcatcaaattttaatatttttgtcaaatttttaggtatttaatttgtaaaacagtttgctttgtactggcatacagaaaatagggtattgattttaaactttttgaagccaagtgatcaagtacatttgtaataaaagtcaatggatctatatcagttgtactcactgttttcatttcttattaatatagggatgctgtactttttcttaaggaaaactgaattaaatttgggtggaagggagggggaaaagataaatccgttgataatgagaatctgggtgggtatcatggcccaagcactttatatcattttttaagtcagttaagatttgatatattttaaaagatactatgtcaacttttttcttcctattttcttatgtaacttgacgtttggggggattatctcattcatttttgtttgtgtgcttttaacattttgtgttttggccctgttcaaactttcta

SEQ ID NO: 44640 - DNA, 494 bp, Homo sapiens
gggagagggtttatgctgctgtggaaatatttttccttctttttggttaaatctgctcccccttgtggtataatctaggtcattatagtgctcatatttaatatctcagaaagataataagttcttgagtgtttactccttaccagatgttaggctaaatgcttcgtatacattttctcattcaatcatcacagccacctttggaaagagatataattatcattcagccctattggatagatgaggaaacacaggattagaaactataactagtgagttgtagaactatgagttgaacttaaatttgtctcattcaaaatcccataaccttaatttctctgtcataccatctccaagagcactccagaaggaaaactttctcattgagggctacagaaatacttgcactattttcctcattttcttatttctccattttaaaaatcattttttcactttcatcctcatctgatagaaatggttatggaagatgc

SEQ ID NO: 44641 - DNA, 1245 bp, Homo sapiens
cttcaaggataatggggcaatcactttcttttcttctttagagtctaccggtgccaaaaggaagggtaaaaaagaacacactagtcaagctcaaggcatgaatggctccctcggctgtaacagctgccttaaggtttaaaacgtgcacatttggaaaagtggaaatgggtttagactccttccgtcatggaggagggtactatttcccatcaaaggtactcctaagaaatgtgtagttgtgagttcatactagacacaaggcaataaacaagttagcgaggtcacagtttaggggcttcacctttataacaccaagaggagcaatattttaaatacggttagcaagtatcaaataatttggttattttcccagcagcaacaaaaaaagaccaagtttaacagtattcaaagttggctgtcctggaggttgaattccctaaagaaagctgtgagaggacagagatgggtgaggaacgagtggcctctgcaacctgagatggccacattgcaaactctttcttgctgcggaacttcttctatttgctaaggaactgccattacactggtgtttacacagcaattccgaaaggaaatggcatcaaggcaaaatcttgatgccatggaaggcccttggaatgatccaattcagtggttttacaaacccaccacaaatcggtgcctcggcagacatttgaaacctctcatctaacccgacttaagtgttccttgccttcctcagggattcctctaatttgtgaagtcactttgaaagaatgcgtgcgtgtggcaggagggagcgtgtggtgacttggtcactgccactctggttccaagttctgtttcaggaggggacaggtcagattttgctccagacataggtcacttccccagggtcggagatgaacttaaaggctaagaaacccagatttaaggtcaaaaccaggagctggaagaggaggaaaagagagtggaaggggttaagaagcagctgggcaagagcagaagatgctccagcagggacagaagcacgacctggccctcctttccatttagagcacattccatctggagaggtcaaccgaaatattaatcatgtggacaggagaaaaggatgtgaaaaaaccatttctcttatctcactttgaaatgtgaaagtgctattattacacttaaaatgcatgaaaaacccctctgctacctgaagagtaggaaaccatccattagttcaataaatactgccaaggc

SEQ ID NO: 44642 - DNA, 1440 bp, Homo sapiens
gtactgttgagggaactctgttcagcagatcttacaaggcacacatgtgccatgatatccagaattctgtaaggcaacatcacaggttgtaaggctataggatgaaattataattttatggttacttagttactgcatttatagtcagcagaggggacagcaataaagtttttgaaatatatcttttttttttttttgagacacagtctcactctgtcacccaggctagagtgctgttgcaccatctcggctcactgcaacctgtgccttctgggttcaagcgattctcccacctcagtcacccaagtagctagaattacaggtgcatgccaccacaccactaatgttttgtggttttagtagagacgggtttcaccgtgttgcacagactggtcttgaattcaactcttgagctcaggtgatctgctcacctccgccttccaaagtgctgggactacaggtgtgggccgctgtgtttggctgaaatgtatgtcttttaaaggagtgtccacagttatccagtcactgtgtctgtgatggataagcagatacagaaattctcaagacttccataataatgaatgttgtgtagctaagctttggtcagaggaaataatctaaaggttttgtgaattcatgtaaccttttgggctgctcaccttaaggtaactcctgtattaacaggaggaacagaatagggaaaaagatctcagttcagtgatgtagctttgtgaccagccagtgatccagttcaatcaggtagaaatgaccttcctgctacatcaatatttgcttctatggaggctagtttccccacttagggcatgagaagaattggtaaagtcaacataaaattgccaaacctgtcaccaaaaatgatggcaaatctgtatttttctcttaaaccgtgttataaaagctgtaataaggtataggctgagcatcatggctcatgcctgtattcccagcactttgggaggccagattccttgagaccagtgtggggaacatggcaaaaccttgtctctaggaaaaatagccaggtatggtggcatgtaccttagtcttagtgatgtgggaggattgcttgagcctgggaggcggaggttgcagtgagctaagattgcaacgctgcagtccagcctgggtgatagagtgagaccccatcttaaaaataaaataaagatataaatgacatccaataaagtacacatatttgagctgtaggataagtcttgaattttattataatcccgtgaaaccatcatcagagtcaccataatgaatttatctaatctatcacctttgtatttacttggagcctttataaagtttttctctctgctcttcaaacaaccattgatttactttgctgtatgatggagtactttccattttctggaattttctgactgatgtaataaagtgtttcctcttata

SEQ ID NO: 44643 - DNA, 1609 bp, Homo sapiens
gtactgttgagggaactctgttcagcagatcttacaaggcacacatgtgccatgatatccagaattctgtaaggcaacatcacaggttgtaaggctataggatgaaattataattttatggttacttagttactgcatttatagtcagcagaggggacagcaataaagtttttgaaatatatcttttttttttttttgagacacagtctcactctgtcacccaggctagagtgctgttgcaccatctcggctcactgcaacctgtgccttctgggttcaagcgattctcccacctcagtcacccaagtagctagaattacaggtgcatgccaccacaccactaatgttttgtggttttagtagagacgggtttcaccgtgttgcacagactggtcttgaattcaactcttgagctcaggtgatctgctcacctccgccttccaaagtgctgggactacaggtgtgggccgctgtgtttggctgaaatgtatgtcttttaaaggagtgtccacagttatccagtcactgtgtctgtgatggataagcagatacagaaattctcaagacttccataataatgaatgttgtgtagctaagctttggtcagaggaaataatctaaaggttttgtgaattcatgtaaccttttgggctgctcaccttaaggtaactcctgtattaacaggaggaacagaatagggaaaaagatctcagttcagtgatgtagctttgtgaccagccagtgatccagttcaatcaggtagaaatgaccttcctgctacatcaatatttgcttctatggaggctagtttccccacttagggcatgagaagaattggtaaagtcaacataaaattgccaaacctgtcaccaaaaatgatggcaaatctgtatttttctcttaaaccgtgttataaaagctgtaataaggtataggctgagcatcatggctcatgcctgtattcccagcactttgggaggccagattccttgagaccagtgtggggaacatggcaaaaccttgtctctaggaaaaatagccaggtatggtggcatgtaccttagtcttagtgatgtgggaggattgcttgagcctgggaggcggaggttgcagtgagctaagattgcaacgctgcagtccagcctgggtgatagagtgagaccccatcttaaaaataaaataaagatataaatgacatccaataaagtacacatatttgagctgtaggataagtcttgaattttattataatcccgtgaaaccatcatcagagtcaccataatgaatttatctaatctatcacctttgtatttacttggagcctttataaagtttttctctctgctcttcaaacaaccattgatttactttgctgtatgatggagtactttccattttctggaattttctgactgatgtaataaagtgtttcctcttataatccctgggtgctctcctgcatcatgcttattttgatgtcattgtagatatatgagttgttcattcgttttatgttgctgagaagtatagtctgccgtgaaatgtcattgtatattcattcattcatccatccatttatggatattttagttgctgcatactttttttt

SEQ ID NO: 44644 - DNA, 327 bp, Homo sapiens
gagctggacaaccctttgaaatgacagagtctagattcttcaccaaacagatgaaaagacaagtagagacaacatgtacttgagatataagctatacatctcatcactggaagaaaggagacttcagcctcttttcaaggctttccagaccacatggaactctccagagccctccttgaaagtttttagaaaaactaccattttcagcaaagattcatgtgattatgctgctgaggaccagtcattctgtaaacatcacatatgtgatgctttgtaaatgtattaattgtggtcaattttcatggatatttcccattaacattgtat

SEQ ID NO: 44645 - DNA, 510 bp, Homo sapiens
agcctcaaaacatgagtgattcacgctgagtcactatccttgatactcctgactattttttcacctatgctgtagatgaaccatgtttcttgcatactgtgtgtctcagctgggatacaattcagctttgagtaatggaaaaactcaaaataacagtggtttaacaaggagtttattttttttctcatgaaaagcctacttacgtgcaatccagctcagatagggttgctctgctccgtaaaatcctcaaggctgattccttccaacttcctttgctacagttcttaggaggtacccttatctccatagtctaaagtggcatccacgttccagataaaaggatggagagatggatgaagaagaaggggtagaagtcaccagccatcacttaagatagttttctagaacctgggaaagtcttattcatgatgtttgggtggaaattttggaaaagatctgaattctacttccagagcaacaccagaagcagagatgacgccagtggtacag

SEQ ID NO: 44646 - DNA, 332 bp, Homo sapiens
tagagatggggtttcgcaggctggtctcaaactcctgacctcaggtgatccacctgccttggcctcccaaagtgctgggattacagccgtgagccactgcacctggccttcctgttcttaaaagcagaatattagtaagttgctaaagagaatattaaaggatgtttaaactactttcccactccaaggacctttgggataattaagtagtttgagattgttaaaggagtttcttagtgtgagaattgcccttaggaaaaattaggctaaaaagttatccatctctagaagtgttaaagctttctaatccaaacttattatgctgctttagt

SEQ ID NO: 44647 - DNA, 380 bp, Homo sapiens
tgaaagcaagttcgatggaaccctgggtccactgtactgggtatgaatcacaatctagataacccagagtacttactgcaaagtcagcgatagctcttctgttttccacattgccgcaaatttcccctaaggtgaggcctgcagctagcttgaatggggaaagtcagggggtaggtataaattaatatcttcataaatttgtatcagcctcacaggtatgaatctgttaaatgtatataaacatataaaatatatatgtatctctatatagccagccaaaagtgggaagaaattgaattgcctctgtattaagagagacataataaaaccagacagtagctttgcctgcctgatgaagggaggtggctcctacaggccac

SEQ ID NO: 44648 - DNA, 348 bp, Homo sapiens
actggtttagggacaaaaatgtcaccaatcttccacaaagcgggtagcaaggctcagagaccttcagggagaatttgaacttggtggcccgcaagggtgccttgctgtgtttgcactttgctgccacagctggcaaatcagcctgatctggctaagctttttgggcctaggccaatctcaggtccagcctttataactgtgactggactgtgtggggcttttggccccttaaactgagctttactctagtaaggctggagaccctcaaggagggcattacagagcccagaattaacacacacaggcaggctaatctagcaaagagagtacttatctgggaattggcag

SEQ ID NO: 44649 - DNA, 602 bp, Homo sapiens
gtgggtggaaacacagcaggagctcaataaaagcagatgaaagggaacagaagtccctattctgagactagttttatcagaaggatgtctgataatggatggtaatgacttttaatggtcttttctccatatcattgaccactctaagcaaaataataattcgaatgataatgaagaaaatgatgcccatgataacaataatgacaaatatgaaatggctaaaataaaacatgaaaccatcctcaaaattctgccatcacctttttaaagtgagaatatatagcacactctatcactcataccctgaggctttgaagttggtgctttctaatcagacttcttatggaccaggttttcatatacaaattatgtttccatggtaaggaataaataagagggagaagttaaaaaggagagattacatctattcaccctattcattaaaatttttttaaatttttttccaaatatgttctgcttatgtatattcactctattcttaaaagcacaataacaaagatatattacagaggaaataaaactatcacaagaattaaattcaaggagttattaagggctactgcagcctcacaattagtttt

SEQ ID NO: 44650 - DNA, 879 bp, Homo sapiens
gttgatatatgtaaaatgtctagttcagtgccttggccatagcacgtacttaatacactatcttttttaaaatttttgtttcattgtaaagagtgtaatatcaagtagggaagatttgatatttctttgtgaattcagatgaaaatccttgctgatacatttcgtttcccaagatattcttctctaaaatatgactagcttaaatgcatatgtgtgtgtatgtatgtatgtatgtatgtgagtgtatgtatgtatatgagtgcatgtatgtagtgtatgcatcaacttaattttttttaacctgtatgtatgttggttgcattttatactttcagaggctctctttcttggcattctgtgttccatctggtttagcacattagtcttgaatttgccactgaagtcttagagagtagaatagttttctttggttgattgccagtaattatgttgtttttttctttatacttcagtgtattattaaagtgaatttcatttggtttgtgtctgagggtgatattaaatgtatatttttaatttttgattgcttgatttcattaataaaagagtgttgggtttttgttgtagattgaatgaaaatttgcctgggctactacttaaagtatgattgtgcttgctgttggcatttagaattgtttgtattcatcaactcagtgtattctatgatgtaagatacagcttggagtttgtcgtcatttcaaaaaatttagaattttgattctatatctcatttttatatgatgattctgaggtgcatgataaatctcttttattgtggccacaataaaatatgcttcttttccccactatgcaaagatagagtcttatgacttaggcaagtattctttcaaaaaaaaa

SEQ ID NO: 44651 - DNA, 366 bp, Homo sapiens
gaggctggtgggcaacccagagctctaactcaacagtagagtaggttagttgctggccacttgcagagtccaattatttagaatgaggcctggcacaaataaggttatttattccaaaggtagcttggggaagtggcacaggcatctgtcttgcatttagctgtcccactttgcttttggaacagaaagtgggcacttctaaaagacaggggaggaagtgagcaggggcaggagtgggttcatgctagctccagtgccttatcaggtggtcgagcttgtgactgctggcacttttgtgggcagaccattatctctccaggccactccctgatgggggagttccatagcaggcatgctttggtctgt

SEQ ID NO: 44652 - DNA, 384 bp, Homo sapiens
ggagcttagatatccccctccacaagaagaagcctctcctgagctgccccagctttgggcccccttgtctttgcacatgctgtcatagcacattacatttttccttcgtaacactgagcacagttaccatgaaataactgactgtgtaattactggtttctcttcccagtagaatgtaaactccataagggcagagacaagtctatctcttctctgttacactgtcacatctcttttcgtgccttatatttttaaactattttgagtggctcccgcctgtaatcccagcactttgggaggctgaggtgggtggatcatttgaggccagaagttcgagaccagcttggccaacatggcgaaaccacatcactactaaaaatacaa

SEQ ID NO: 44653 - DNA, 178 bp, Homo sapiens
tggccagaatgtagtctcagcttttaatataatggaaccatggctttattccctggtgaaagcattcatccctgatatacctaagagcccaaggttgtggagacagaaaaaaagaatcacatacttcttcagtaggttaactggtgcaatagtgaaaagggccactgctttcatgact

SEQ ID NO: 44654 - DNA, 623 bp, Homo sapiens
cccagatctgtgattactccctctgcttgctccatcaagttaaaatttttctgcatgacttttctcatctcaagctaagtaaaatccagagtgctaccccggccccacgtgacctggccttgctacctctttgacttccacactccttcccactcactccactccagacacatttgctatttctctagctattcaagcacaagcctgccattacacttatttctgttacttgggatactcttccccaagacatctagggaactcaaactcactcctttaggcccttgttcaaatattactttaattgaagagggcttctctaaatatcctacctgacacagctcactctgtgttcctcttactctgcttatgtttcttcataacacttattattgttatatatttgtgtcttttttattatcttatttgatagagatgaggtctcaccatgttgcccaggctgctcccaaactcctggcctcaagtgatcctcctgcctcagctactcgggaggctgaggcaggagaattgcttgaacccgggatgtggaggttgcagtgagctggaatcgtgccactgcactccagcctgggggacagagcaaaactccgttaaaaaaaaaa

SEQ ID NO: 44655 - DNA, 410 bp, Homo sapiens
tggaagaatgaaagaatctctgaagtgttgattggctgtttctggaacttggcccaagttcctactacagatgtaccatgtccacttttctcagaattcaagtttcctggttgggccctgacttaaatgtgcagtgttagaaaaaagtgaattatttcacccaaatgaagaagcaacacattgtgccatttgaaattctcaagtgaagtgcaaaagtttccttgtccgtttacaatccacttctgagtaatctgacccaacgtcatcagagagaaaatggcttccttggggagtgctgaaagcattagagagatgtgaccagagatctccgtcacactgattcctcccttaccttgccaggagcactgggccagcctacattggctactcagcgcttgtcgaggttgggt

SEQ ID NO: 44656 - DNA, 507 bp, Homo sapiens
aagatttttttttctttcttcccttcttcttccttcttctccctactcccttctcttcctctttctcctcctccttccttctccttctttttctttttggaaaccactgatttaaccctgagagagggaaaacttgtcctggcaagaatttccaaagctcagttttattttttaagacaaagtctcgctcttgtcactcaggctggagtgcagtggcgtgctctcggctcactgcagcttccgactccctggttcaggagatttttctcgtgcctcaggatcccaagtagctggtactacaggcgtcatcatgcccggataaattttctacttttagtagagacggggtttcaccatgttggccaggctggtctcgaactcccgacctcaggggatccacccgcctcggcctcccaaagtgctggtattacaggcgtgagccccagcgcccggccccaaagttccgttttaccctttttcccacgctgaggctacagctgaacccag

SEQ ID NO: 44657 - DNA, 388 bp, Homo sapiens
ttccatctcttttaacagagtggatggagttaatcatctgaagcctcttctaatttgaatataagttctctgcactaatttttattataggaaataggttttcttgctgcctcacattgttcacaggacatcagagaataaatgtgatataggcaaatagaatcctaaggcctttctgaattactaggctgtttcttaaagggtattagatatttacacaacacttgttctggattctggcccagctaccattgtggtaaacaaacagctccacccctcatggtcttcagcaagcttttcatgaacacaaaccacaagcacctcatctcgtgccctttccatgtgtgtgctcttcccgggcttccccgttcactcccagttgagtcag

SEQ ID NO: 44658 - DNA, 447 bp, Homo sapiens
atttaagtgattctcatttcttcatttctacttcttttatttatattccatttcttcccactttgctaacttgcttccctatcctttactgtatattctctacttagttgttctggttccttataacagcttcatatttcctcttcggtcttgtgacctcagttaaatgtttaattatagaaataatgtgcacgtggttaaaaaaaaagtcaaatagtaccaaaggctacacaacagtggttctcaaccaggggtgactttgcccccaccccctgcaggaaacatttagggcatgtctgggaaacatttttggttttcacaactgggggagggggtggtagtggaaagaggtcaaggatgctgttaaacaacctacaaaactcaggtcagctactcacaataaggaatttctcacccaaaatttatagtgctgagggtgagaaatcc

SEQ ID NO: 44659 - DNA, 349 bp, Homo sapiens
gctaatccttaacagattaatctgagtttatatttagatgaaagttattcattaatagaaaaacctgaaactgtagtgagggctgacagtgtttaagtggatagaggtacataggccacctttagaccaaaaagtctttgtaaggcactggagtctttaagtgtctgctttggcacaaggacatcaggttatccttaggaagccaggaacaccttgagactcgggccagaacaatgtggcccacctttgagcttcaggtttggtcccagtgagtctcacgcctttttgatgctgaccatatatatggggcaaaacactctgtaatctgctttaccccactacacccatc

SEQ ID NO: 44660 - DNA, 127 bp, Homo sapiens
gtctgtagaacccagaaatggattcaagtgtatctctttaaaagagaggtttcagcctgccgcgaagcgttctgttcacaatccggccagcatgtatgttgctgttgtctgatgctgtgatgctgtt

SEQ ID NO: 44661 - DNA, 510 bp, Homo sapiens
gatggatatgttcattggcttggaatcattccacagtgtatacatacaacatcacattgtgccccataaatatacacaattatttagatgtgaactttgtccccataaggatggagctttaaaaagaacagataatgggggttgggcccatgaggtgtgtgctctgtatattccggagtacaatttgccaatgattccacaatggaaccaattgttttacagtctgttccacatgatcattgtaataaggttgagactgagctaaagttaatctgcgggcgatgttctgggatgcactggacaaacacctcattccagcagctaccactggcaagtccaaggttttctattatgaaatgtaggttctatactagaaaggaaaatgtaagattaaaagttggcctttttagaatcatgactttcttctatgtaggtttccaacttttatttacaaataattgtttaatgttagaaggatagttgatgttggaataaaaagatggtcaggct

SEQ ID NO: 44662 - DNA, 524 bp, Homo sapiens
ccataaaacaggaagtaaacaggtaacaggcagatgttaaaaaccttgccccattcctgtgttgagaggacttttttgtttttttctcccgctccccagagatgtgaactttgtccccataaggatggagctttaaaaagaacagataatgggggttgggcccatgaggtgtgtgctctgtatattccggagtacaatttgccaatgattccacaatggaaccaattgttttacagtctgttccacatgatcattgtaataaggttgagactgagctaaagttaatctgcgggcgatgttctgggatgcactggacaaacacctcattccagcagctaccactggcaagtccaaggttttctattatgaaatgtaggttctatactagaaaggaaaatgtaagattaaaagttggcctttttagaatcatgactttcttctatgtaggtttccaacttttatttacaaataattgtttaatgttagaaggatagttgatgttggaataaaaagatggtcaggct

SEQ ID NO: 44663 - DNA, 413 bp, Homo sapiens
ggcttgaacccgggaggcagagcttgcagtgagccgagatcgcgccactgcacttcagcttgggcgacagagcgagactctgtctcaaaaaataaataaataaataaatacataaataaataaaagccaaccccttcactagggattataagaaggccaaagagtaaaggctgctgaaagccttcagctgggcctggcttgggttcaactgcccttggcagccgcaaagcaccccaaggtggcaggagctcccagctcgcccatctgcacccatggtgatgtggctggtgaacccggcaccaggccagcacctggaacagagcagggagtggtctaggaccttcctggtgtggccattatctgggtgtcttaagaatttgagagctcaggctgggcatggtggctcatgcctg

SEQ ID NO: 44664 - DNA, 450 bp, Homo sapiens
cttaatctcaactgtacaacatgctcagctggagagcttttaaaagtacggatgcataataaaaagtttttaaaaaaaatgatactgatgccctagccctagccctgccctagatgaagtaagttagaatcttggggtgaccctgggccttggtgggagtctgacttctcctgctcctccctcccggccccactgtttcttccatagcctcagcctcctcactgttccttccatagcctcagcctcctcactgttcctcccatagcctcagcctcctcactgttcctcccatagcctcagcctcctcactgtttcttccgtagcctcctcactgttcctcccatagcctcagcctcctcactgtttcttccatagcctcctcactgtttcttccatagcctcctcactgttcctcccatagtctcagcctcctcactgttcctcccatag

SEQ ID NO: 44665 - DNA, 630 bp, Homo sapiens
cacctggaaaactcctattcattcctcaaagcccagttcagatggcacctctccatgacttcatcagattccctacagaggtgctgattttctggtctcttgtgtttctgttgtaacacttaacatgctgtattataatgtgcttattttatttacaagtttgttacattgtacgtgctcgaggacaagcagccggtagtattcacctctgtcatcacagaagctggcgtggagccctccacatgagggcactgatgtgtttgctgagtgactgggacaatggtgggccacgtgagccccgaaactttcagtgggctctgaaagttaagaaaagggcattcagtactgaaatcacacaaaacgtaaatttaatgatataattgttccgaagctgctctataatttggcatgaatggagagcagtttacaaaaatgacaacaccactgttatataaacccaattcttaaataggttttcttctcttgctttgtatttcctcaagtgggtgatacttaatacagtggctcatgtaatcttaattactacatatgaggacacggacatgtacatatgatgctgattactgttatttttggaagtaaaaaaattgtaaaatttgaaaaaaaaaa

SEQ ID NO: 44666 - DNA, 518 bp, Homo sapiens
ctcgcctgtcccccggagggacagaggggccgcgtgcggctgagtccgttggaaaccacctttgcaaaattgtaactgaggaaattgtgatggtgaaagaaatcagacctaatcaactccatcttgcctctaacctttaagctgtccttgtttattcctgggcggaagcccaactaaccttgggaaggaattcagtccatggtttgactctgaaacaaaattgataagagcctgtgaatcctgaaaatggaggcatgagacaacaatccttgaatcagctcagtggatcagctgacaccacccacaccgataatctgcctcaaccagttctgccaaaccaaccaggaagagtaaatagcaagaaaaactccaacaacctctgattccatcttcaacctggccaatcagcactccccacttcccaagctcctacccgcccaattgtctttaaaaactctgttcctcaaatgctcggagagactgatttgagtaataataaaactccagtctcccacaca

SEQ ID NO: 44667 - DNA, 557 bp, Homo sapiens
agcaatgaaggaatgaagggttttattgaaaaagtacactccacagtgtgggagcaggcctgaacacagggactcaaaggcccggcagaatttctgtgaatttaaataccttctgcttggggtacgcccgatgtaaatgaagacggtgaagtaaagttacgaagtcatttactcggtgtatgccctatggagagggtatttccccttatagctgaagcgtgaatcggccttatgttccctacctccagaccctattttcctgcctcacttggtcttttacattttagggaggcatgagacaacaatccttgaatcagctcagtggatcagctgacaccacccacaccgataatctgcctcaaccagttctgccaaaccaaccaggaagagtaaatagcaagaaaaactccaacaacctctgattccatcttcaacctggccaatcagcactccccacttcccaagctcctacccgcccaattgtctttaaaaactctgttcctcaaatgctcggagagactgatttgagtaataataaaactccagtctcccacaca

SEQ ID NO: 44668 - DNA, 380 bp, Homo sapiens
actactactaaattcgcggccgcgtcgacggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44669 - DNA, 374 bp, Homo sapiens
tcaagcttctaacgatgtacgggggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44670 - DNA, 1844 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgttgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44671 - DNA, 1743 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44672 - DNA, 1528 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgttgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44673 - DNA, 1416 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgccctgtcgacgcggccgcgaatttagtagtagta

SEQ ID NO: 44674 - DNA, 1168 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagtatcacatgttccggcacagtatctacattaccgggaccgagctgatga

SEQ ID NO: 44675 - DNA, 1713 bp, Homo sapiens
cccgcgggtaatcggccgaggagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgttgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44676 - DNA, 2488 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgttgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaaaaaaaaaaaaaaaaaagaaaaagaaaacaaaaaaaaaaaaaaaaaaaagaaaaaccagaacaagaacaaaaacaagacaaagaaacaagcaaaacaacaaaaagagcggggcgcacacagagacaaaataccgccgacgaagggaggccaagactaacagagaacaaacagagtcaagtactaacaaaaagaagggacccacaaaaacaagggaagccgacgaaaaaccacaaagagcgagagcgcgaaagggcggccgcggagagataaaaacaacagacagcggacgacgggaggaaaacagaacagacgcacaacgaaagatacacgcgggggagaagacgagaacaaccaaaacggggggagggggacaaacaaaaataaaacaatggtggtgagaaacagaaaagactccacagccccgaaagaacgattaattagtaaacaccaaattatgtgaggaagaaaaacatcaaacatcaccgccataacgagatatgaaccaaaggtagataggcataaacacgacagagctgagatggcaaattcgaatactgggtgaacggtcaagataagactaaatctctctgtgatctatctactgattaattgactatcatatggcagcgccaaacattgtatcg

SEQ ID NO: 44677 - DNA, 1802 bp, Homo sapiens
  misc_feature (28)..(28): n is a, c, g, or t
  misc_feature (75)..(75): n is a, c, g, or t
gacgatacgccgggcgcaggcgcagaanccgcgcccgtccgcggcgccgccagccagggcggaaacggctgcggnttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgttgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44678 - DNA, 1175 bp, Homo sapiens
aatacacagcggaggagacagctcagaggccaggaatcggagcgaagcagagaggtggagaactgggatttgaacccccgccatccttcaccagagcccatgctcaaccactgtggcgttctgctgtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgttgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatattacaaaaaa

SEQ ID NO: 44679 - DNA, 298 bp, Homo sapiens
cctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtg

SEQ ID NO: 44680 - DNA, 434 bp, Homo sapiens
ctcctgaaggaacctaattgtttcaagagcttgaggaagaagtgatgaatagacttgttagagtaaatgcttgtcttacctataaagaggaaatgatatgtaaatatatttaacatcatcctctaatgaaaggattttacatggaggtgaagaaatggcctggctgcacgcattctcgtgtacatttgcatgaggggccgtggtgcctggaggagataggtcagctggaccccaggacgaggcggagaagtctcgggatctgggagtggaactgtccggcctcccttatggcacttgcccagcttctgcagggggaaggcaagactctgcccacgcctctgttgcaaaaacattgtggaaggctcaagggccggaagtacccagctgcaccgcgtagggaggacgctgctcgggctcgagtcatctgcacctgg

SEQ ID NO: 44681 - DNA, 318 bp, Homo sapiens
ggaaattagaaagtattttgaacagaatgaaaatgaaaatgcagcatttaaaactggtgggatgcagctaaaacagtattaaatgttaagtctcaaatcagtgacctcagcaatcaccttatgaaactagaaaagttggctgggcacggtagctcactttggcaggctgaggtgggcagatcacttgaggtcggaagtttaagaccaccctggccaacatggtgaaaccccatctctactaaaaatacaaaaattagctgggtgtagcagtgcatgcctgtgcacgcctgtagttccggctacttgggagcctgaggc

SEQ ID NO: 44682 - DNA, 287 bp, Homo sapiens
taaaaatttcacttatttaaaagcaatacacagttaagaaccactatttgtcattgttgttgtttgaaacagagtcttgctctgtcacccaggctggagtgcagtggtgcagtcttggctcaccgcagcctctgcctcccggaaacaagtgattctcctgcctcagcctcccgagtagctgggattacaggtgcgtgccagtacaaccggctgattttttttgtatttttagcagagaacagggtttcaccatgttggccaggctggtctccaacttctgacctcaa

SEQ ID NO: 44683 - DNA, 651 bp, Homo sapiens
tgagacagagtctcacatctgtcacccaggctggaatgcagtggcgcaatctcggctcactgcaacctccacctcccggcttcaagctattctcattccctagcccccggagtagctgaggcaggataatggtgtgaacccgggaggcggagcttgcagtgacctgagatcatgtcactgcactccagcctgggcaacaaagcgagactcgtctcaaaaaaaagaaagttacatctttcagaaattgtccaagttgcattaaaaattaccaacacaaattctagggtggcaaattactttgacaaaaaagctaaatttatatatcatggttttaaatctcaatcaaaatctatcacaaatcttacccagaaaagcatacattaactgcactttttcgagtcagaattctttctattccaagtaagagaatcacatttctacaaagtattttttggcccaaaattacattaccacattctaattgttcattgttccagagcattcctgcttttagagatttaataaggaagtcatcctgcaattaaggccaggacaaggtctgattccaaaaagacatagcccctgtattccaaggtctattaatctgtataacatttgatccaaattttttaagttacctagtgctttaac

SEQ ID NO: 44684 - DNA, 391 bp, Homo sapiens
ggttatgtgatttactgggaatatttagaaacaattttttttaaaaaaaataaaggtagaaaatgtaaacaatttcagatcatatccacaaaaacaggtatggggaaaaatctgaaaggatgaacatggtgagaaacgggaaatagaagtgtgctgtatttcactcttttgcaaggggagtcattagctttggttttattcttgacattgataaagaaatacagatttagttgacatctggattaaaagagcagattgaaactctcctctagagttctccccccaatacctaacatttagcaaaaaaaaaaatgagtttaaaagcatagccccagcccccaaattgtcatcagtgtcactcaaggaaaggatcccaacttaaagccaaaaa

SEQ ID NO: 44685 - DNA, 456 bp, Homo sapiens
accacatccagctaatttttaaatttttttgtagagtctgggtctccctgtgttccccaggatggcctcaaacttctgggctcaagcaattctcctgccttggcctcccaaagtgttgggattataggtgtgagccacggcgcctggccccctggtacttctgttgaccaaaatacttataaactgttaatgtgcttgtttggtttgcaaatagctaggttttttttttgtcttcttgaaattccttttatcaaataaaacttaaatggcctctttttaaagaactcagtattaaatttggctgcaaagatgatataagcaatgtagaagacagaaatttattttcatcacgttcaacaaattctgaagtagtcagtgctctaaggtatatggtgtctattttcagatttagcaaatgatcctggaggttattggagctcgtacaaaaagaagaga

SEQ ID NO: 44686 - DNA, 380 bp, Homo sapiens
agcccatttgatgctctcaaaccctaggagccttagatcactctcacatcctccaaagagggtgaggggcctctcaagaccttttcaccctttccatgaaaccctttggcttgctcatagcctggctggaacctttcctctctgtgtttttccctccaagactggctcttatttaagtctatttccaccaatataaatagtggtcttcaggggccctcatctctagaatgttccttatagggagtatttgttctcatcttttaaggtcactccaacactgagaggtagaattgggaccataaacagactagtttatcctaacaagctacatataaacactctgtcctacatcttgctgaaacctagacgtgcccactatt

SEQ ID NO: 44687 - DNA, 611 bp, Homo sapiens
gcaagcatggagcactaggcgcaggggatgggcaactggcaagcggggagatgcatgcagcgcacttagtgcctggtacataccaagtccttttagtctggatttcattatttttaaatgggtattgctatttttaaaagaatagttacaaatatttattgtgtgttttgaaataagtgggtcaagatcaataagatattgttgatcaattgatcaataagatatcttttattcttaaaaatcatattcttctggttcagtggggaagagactgccgacctgtatttacagcattatgtgataagtgttctccttttcaggtatgtattagtctgttctcatgctgtcaataaagacatacctgagactgggtaatttataaaggaaagatgcttaattgactcacaattcctcatggctgaggaggcctcaggaaacttacaatcatggcagaaaaggaagcaagcatatccttcttcgcatgatggcaggaaggagaaatacagagcaaagtggggaaagccccttataaaaccatcagatcttgtgagaacgcaatcactatcaagagaacagcatggaggtaattacccaccggctccctcccatga

SEQ ID NO: 44688 - DNA, 354 bp, Homo sapiens
tagggacgtttggaaacaaaagacaggtaaacaaagacacgcaatgtctcaagacaaagtctggaggtgaaattaaacctttttagacaagtccaaccacttaatgaaaagaatgaagaccggtggttctctaactttgactggaggctagtggctaacagtggattagaggccaaagtctccctcatagcgcagtaacatttctgagatgtgaacgccgcaagactcccccaccccttttgttcgctactgcctccccatggcttaaaacagcagaagctctctaagtatctgctgcctgacttaataatacaaaaagagcacagacaaatcaatctgccattaggagatttt

SEQ ID NO: 44689 - DNA, 453 bp, Homo sapiens
tgccacgggctgtgaccatgatggagggagccagcctcctggtcagcgagacacacctgcagcccctgtctccaggaggcttggtttgcattacttgctgcagcccctggggccaccctctttgctccagatgggccgagctcaggggaagtgggagctcctcagatgagcttggacttgttgagaggaggacttggggctggggttgcccatggatcatgcaaggggcagtggcttttctggtaggcacaggggccttagggaaggtggccatccagggtggggcctcatcctgtgggactcagcgcatggtggcagccagccccccagcatcccactaaagacagcctcgagctgactgtggtccctcctgcgtgtgcattgcaggcctcactgtgagcaagctgagggtcccagtgtctcctgcccggtccactgtgggggctgccttgg

SEQ ID NO: 44690 - DNA, 801 bp, Homo sapiens
aaccttttgtctccctcagatgatttgaaaagcaatttaaacccagaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44691 - DNA, 480 bp, Homo sapiens
  misc_feature (16)..(16): n is a, c, g, or t
ggctgatctagaggancccatgcgcgacgccaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatggaagcgtcgcgctgggtaccgagctcg

SEQ ID NO: 44692 - DNA, 2133 bp, Homo sapiens
taagggatatgtcgaccacgccgtcgctgaagacagagcgatggtagttctggaggcctcgctccggggccgacccgaggccacagtgcctccgcggtagaccggacttgggtgacgggctccgggctcccgaggtgaagagcatcgggggctgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44693 - DNA, 2392 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactgtgcccaggggtgcactgttgggtttttctttaaaatagagtactttgtattctgggagaatcaagttctaatgaatgcaggtatgtggaaattctgttgaaacttctttagagttagttttagttttaaaaaaagactctagtaaaaatagatagctgttgaggaagccttgtttgtgtagatctgaataatggaacagagatgttaaactaattttaaggggaaataaaggctacctccttgatgcttagtcaaggtcacccagatagtctgta

SEQ ID NO: 44694 - DNA, 2052 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44695 - DNA, 2751 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgaggtgaagagcatcgggggctgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggtgcctactacttctcagcccccattccttgccaaaggctagtagaattttaattaaatccaggaatcgagacctggagccaggtgatagagatgcatcatcacctagccttttggccctttcagaaaagatgtattcccttatacctggcccgtcaccttccagtatggattttttcctgtagctgttcacagagtgggaaaggatagtagctttaatgatgaagtattgaaaaaaattgagggagtgattgaccaatcaccaagagatgggctcttgagaagtttcaaactagcaaatgttgttagatgttcaggtccttagttctcattgctgcaggtaaagagcttgctggcaaggggtataatattttcttatgctccctctccctccttagtccaccaaggccaaccttcatgctgagtgtccctgtggaagaccagcatggccttcctttgggagagaggtacccttgggaggtcagtcgggctaggagtgggtatgttccttgaggcccctcagctggtgcttgagagtctctgccactggcattgtagtaggtggaggaagcctctctgttccctcatgtggcccgtgggcggggggctgtctgcaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44696 - DNA, 2836 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggtcagtatagcgcaatgctgagtgaacttgtataggaccaaattgaacagaattgaagcagcagtaataatggaggcaaaacagtataaatggtgggaaagcaaaaaatggccagaatcacatgacttgatgggcagagactgacccagtactgcaagcaggacagaatgtgaccacctagtccttggagtagaagaatgttgccttagatggtttagggggttttcttggcatagagctcaagcctcctctccagtttcaagaaggtttttccctgaagcccttggaaatacacaggaatgcttcttttgatttttctaggatcccattgatggatggaaactctagtttttacttagagtaaggctgcttctatcaccccaaaacaaagcatttcttttcttctgcctcctttctcccccgccaagttcagggatgcctaggaaaacagcaagaagtactgtaaccctcactcacccctactccaggcttctcttctctttgggtgtgtgtcctgtccctgtactctgcaatgacaatgaggctcttgtgacagtcttcttgatttttggctttcaagcaaatccaaaatacactatcattcctcaccaagtgttctttaatagataaaatgacgtgaatggtcccatgatcaagtccctgccccgaacttacttaactcagatctcagttactaatgagttttgctctgtccatctgcaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44697 - DNA, 2096 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggctgaagtgcaatggcatgatctcggcttactgcaacctccgcctcccgggttcaagcaattcccctgcctcagcctcctgagtatctgggattacaggcatgcaccaccacgcccggctaattaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44698 - DNA, 1885 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccagacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44699 - DNA, 2785 bp, Homo sapiens
  misc_feature (1599)..(1599): n is a, c, g, or t
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgcctttctcaacctcttctttgaactgctgcacacagtccaggaaaagccaccattgcatggtcaaacttgttgtcccagaaaanccgcaaccccccagaacagtataacggcagctccttagatttgtctgtcagagactccagatatgaatggtttccgtaaggaacaagtcggtatctctgaaatttcagacccatcttattggccagagcatggagcagcaacacagtctggccccaagcagcattaatctcattccattccacgggaacactgggcaggcgacccagcctgaagttattgattgtgccaaactgtccactgtgccagatgtggaaggttgcattaaagacgttggttttcttcagcttatccagctgcgtctgggcataacgcatctggttttcaacactcttcagctcatcatccagctccagctgctgtcgtttaaattcactgtattctctctgatactgagcttcctcctgatccagtctctcagcctcagcctggaccttctcgagattttctgccactatcttgcggttcttttccacgtcttccagctcctggatcagcctctcctcctctagtgccagctcctttagctccatctgtaactgttcactgtcatcctcattcatttgctctaagatctccaaacagcgtttgtagttctgacactcattttcagtgacgttgagctgagtgtccagctggtctaaaagagtatctgtgcattcctcacagagtgggtgatccacatctgtctggcccgacatgatgtcaaaaaggtccccagtgaccttcagtcttcggctgaggttctccatggtgccgccatcagatgcctccccaatcagagtgaagctgttggcactttctgtggacatcatcctggctggggggatgaatctgcgagagacaccatcctggcgaggagtttcaataaatggctcctctcctgagttagtctcttcctcctgggtctctcctggtttcgcctgggctgtggtaagtaatggagctgtgagttcctggatggtgacacggtccaggatcttgaaactcgtgtccagtttcaggggctggctgcagcgctggcacacgaagctcacctgcatggtgctgttgttggacgtcttagacccttccatccctcgggagcccggagcccgtcacccaagtccggtctaccgcggaggcactgtggcctcgggtcggccccggagcgaggcctccagaactaccatcgctctgtcttcagcg

SEQ ID NO: 44700 - DNA, 1774 bp, Homo sapiens
taagggatatgtcgaccacgccgtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacaggtcagcgagacccttggaaagagggtggtcaagaatgtggaaggtgggcagctttggtgatataattcttatggtggctgtgtagtctgccacaaactcatcgtgtgaacctaggaaagtcacttcatctggctccctgttttatatatacctgatacatgtagtctgaggtaatttcatacaatattttaaataattttgtgcatgaaacaaagcttgtatacattgaatcatcagaaagcaaagggccgggtgcactgctcctggtctatttatttatttttcttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44701 - DNA, 1402 bp, Homo sapiens
ggattacaggcatgagccaccgtgcctggcctgttttatatatacctgatacatgtagtctgaggtaatttcatacaatattttaaataattttgtgcatgaaacaaagcttgtatacattgaatcatcagaaagcaaagggccgggtgcactgctcctggtctatttatttatttttcttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44702 - DNA, 1118 bp, Homo sapiens
gtatttccccccacctttctgccttcctctgtaggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44703 - DNA, 788 bp, Homo sapiens
tgacgcgccgtccagtgcagctgagtgacttagagaccccaggtctttcccctcaaacaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44704 - DNA, 1230 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaagagctgccgttatactgttctggttgcccggttttttctggacacccctcgt

SEQ ID NO: 44705 - DNA, 1407 bp, Homo sapiens
gcacataatgttctctctgctaggaacaaccccctctctgcagacttctactttacctctcagtttaaacgtaagtcccctatggggaaactctccatatggcctccccaaactggatcaagtgcccttatgtgttcccacagcaccctgggtttaccatcatcacactgcattacaactgcttgttatttatccatctcttccaccagattatatgcaactagaaggttgactgcatactgttttgctgttgccctcctagcactcagcacagtgccttttccagagtagacactcaacagttattaaattaatggaacatcaaacaccgtggggataagaaatcagcaccagacagcttaccaggtttttaagtggctgaagggctcaggccttttcctttctttagaagggcggatgtcaccaagctctagaattccaatccctactgtgcctatcccatcacagatgtggaaggttgcattaaagacgttggttttcttcagcttatccagctgcgtctgggcataacgcatctggttttcaacactcttcagctcatcatccagctccagctgctgtcgtttaaattcactgtattctctctgatactgagcttcctcctgatccagtctctcagcctcagcctggaccttctcgagattttctgccactatcttgcggttcttttccacgtcttccagctcctggatcagcctctcctcctctagtgccagctcctttagctccatctgtaactgttcactgtcatcctcattcatttgctctaagatctccaaacagcgtttgtagttctgacactcattttcagtgacgttgagctgagtgtccagctggtctaaaagagtatctgtgcattcctcacagagtgggtgatccacatctgtctggcccgacatgatgtcaaaaaggtccccagtgaccttcagtcttcggctgaggttctccatggtgccgccatcagatgcctccccaatcagagtgaagctgttggcactttctgtggacatcatcctggctggggggatgaatctgcgagagacaccatcctggcgaggagtttcaataaatggctcctctcctgagttagtctcttcctcctgggtctctcctggtttcgcctgggctgtggtaagtaatggagctgtgagttcctggatggtgacacggtccaggatcttgaaactcgtgtccagtttcaggggctggctgcagcgctggcacacgaagctcacctgcatggtgctgttgttggacgtcttagacccttccatccctcgggagcccggagcccgtcacccaagtccggtctaccgcggaggcactgtggcctcgggtcggccccggagcgaggcctccagaactaccatcgctctgtcttcagcg

SEQ ID NO: 44706 - DNA, 1330 bp, Homo sapiens
taagggatatgtcgaccacgccgtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacaggtcagcgagacccttggaaagagggtggtcaagaatgtggaaggtgggcagctttggtgatataattcttatggtggctgtgtagtctgccacaaactcatcgtgtgaacctaggaaagtcacttcatctggctccctgttttatatatacctgatacatgtagtctgaggtaatttcatacaatattttaaataattttgtgcatgaaacaaagcttgtatacattgaatcatcagaaagcaaagggccgggtgcactgctcctggtctatttatttatttttcttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggtcagtatagcgcaatgctgagtgaacttgtataggaccaaattgaacagaattgaagcagcagtaataatggaggcaaaacagtataaatggtgggaaagcaaaaaatggccagaatcacatgacttgatgggcagagactgacccagtactgcaagcaggacagaatgtgacaactaatctggagtctgtgccttaggtaggggtatctggattagttagcctcttccattacgaggtttcctgagcctggattacggaggtcctggattaggtcctgaggggacctgttactcatagtgttattccacagatttttcgccgtaccggtcggtcttacgtgcccc

SEQ ID NO: 44707 - DNA, 629 bp, Homo sapiens
taagggatatgtcgaccacgccgtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacaggtcagcgagacccttggaaagagggtggtcaagaatgtggaaggtgggcagctttggtgatataattcttatggtggctgtgtagtctgccacaaactcatcgtgtgaacctaggaaagtcacttcatctggctccctgttttatatatacctgatacatgtagtctgaggtaatttcatacaatattttaaataattttgtgcatgaaacaaagcttgtatacattgaatcatcagaaagcaaagggccgggtgcagtggctcacgcctgtaatcccagcactttgggaggccaaggcgggtggatcacttgagcaggagtttgagaccagcctgggcaacacagtaagaccctgtctctat

SEQ ID NO: 44708 - DNA, 818 bp, Homo sapiens
tccgcctcccgggttcaagcaattcccctgcctcagcctcctgagtatctgggattacaggcatgcaccaccacgcccggctaattaggtatttttagtagagacggggtttctccatgttggtcaggctagtctcaaactcccaacctcaggtgatctgcccaccttggcctcccaaagtgctgggattacaggcgtgagccactgctcctggtctatttatttatttttcttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggtcagtatagcgcaatgctgagtgaacttgtataggaccaaattgaacagaattgaagcagcagtaataatggaggcaaaacagtataaatggtgggaaagcaaaaaatggccagaatcacatgacttgatgggcagagactgacccagtactg

SEQ ID NO: 44709 - DNA, 2113 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44710 - DNA, 2034 bp, Homo sapiens
gtaccctctgtgctcttgctgttcccttggcctagaatgctcttccttaagatgcagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44711 - DNA, 2239 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggctgaagtgcaatggcatgatctcggcttactgcaacctccgcctcccgggttcaagcaattcccctgcctcagcctcctgagtatctgggattacaggcatgcaccaccacgcccggctaattaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44712 - DNA, 2113 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaatttagagttagccttcacttaacgcacagctttc

SEQ ID NO: 44713 - DNA, 1790 bp, Homo sapiens
accatcctggcgaggagtttcaataaatggctcctctcctgagttagtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44714 - DNA, 1909 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44715 - DNA, 1612 bp, Homo sapiens
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaa

SEQ ID NO: 44716 - DNA, 2887 bp, Homo sapiens
  misc_feature (1599)..(1599): n is a, c, g, or t
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgcctttctcaacctcttctttgaactgctgcacacagtccaggaaaagccaccattgcatggtcaaacttgttgtcccagaaaanccgcaaccccccagaacagtataacggcagctccttagatttgtctgtcagagactccagatatgaatggtttccgtaaggaacaagtcggtatctctgaaatttcagacccatcttattggccagagcatggagcagcaacacagtctggccccaagcagcattaatctcattccattccacgggaacactgggcaggcgacccagcctgaagttattgattgtgccaaactgtccactgtgccaggtttttaagtggctgaagggctcaggccttttcctttctttagaagggcggatgtcaccaagctctagaattccaatccctactgtgcctatcccatcacagatgtggaaggttgcattaaagacgttggttttcttcagcttatccagctgcgtctgggcataacgcatctggttttcaacactcttcagctcatcatccagctccagctgctgtcgtttaaattcactgtattctctctgatactgagcttcctcctgatccagtctctcagcctcagcctggaccttctcgagattttctgccactatcttgcggttcttttccacgtcttccagctcctggatcagcctctcctcctctagtgccagctcctttagctccatctgtaactgttcactgtcatcctcattcatttgctctaagatctccaaacagcgtttgtagttctgacactcattttcagtgacgttgagctgagtgtccagctggtctaaaagagtatctgtgcattcctcacagagtgggtgatccacatctgtctggcccgacatgatgtcaaaaaggtccccagtgaccttcagtcttcggctgaggttctccatggtgccgccatcagatgcctccccaatcagagtgaagctgttggcactttctgtggacatcatcctggctggggggatgaatctgcgagagacaccatcctggcgaggagtttcaataaatggctcctctcctgagttagtctcttcctcctgggtctctcctggtttcgcctgggctgtggtaagtaatggagctgtgagttcctggatggtgacacggtccaggatcttgaaactcgtgtccagtttcaggggctggctgcagcgctggcacacgaagctcacctgcatggtgctgttgttggacgtcttagacccttccatccctcgggagcccggagcccgtcacccaagtccggtctaccgcggaggcactgtggcctcgggtcggccccggagcgaggcctccagaactaccatcgctctgtcttcagcg

SEQ ID NO: 44717 - DNA, 2301 bp, Homo sapiens
  misc_feature (1599)..(1599): n is a, c, g, or t
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgcctttctcaacctcttctttgaactgctgcacacagtccaggaaaagccaccattgcatggtcaaacttgttgtcccagaaaanccgcaaccccccagaacagtataacggcagctccttagatttgtctgtcagagactccagatatgaatggtttccgtaaggaacaagtcggtatctctgaaatttcagacccatcttattggccagagcatggagcagcaacacagtctggccccaagcagcattaatctcattccattccacgggaacactgggcaggcgacccagcctgaagttattgattgtgccaaactgtccactgtgccagatgtggaaggttgcattaaagacgttggttttcttcagcttatccagctgcgtctgggcataacgcatctggttttcaacactcttcagctcatcatccagctccagctgctgtcgtttaaattcactgtattctctctgatacctgtgagcagccaagggggccattgaaggctgttagcttgggggctacagtttctctctcaccacactatgaacgattctttaatgatcatcgttacatctagctctcgcatcttttatatttggcatagatcccattctgaggaacatgtatgtcctagctgttttgcctggaaggaccagaaatgtctcaaattccagctgcccatatgcaaaaaggtggcggaaaaaagactactcccaaaccagggcaaaaaacctcttatacctgatctttaccagcagtgaggtgactggctcacgagtgcctct

SEQ ID NO: 44718 - DNA, 672 bp, Homo sapiens
  misc_feature (660)..(660): n is a, c, g, or t
aagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaggatacacgtgaccgataccagattggggttaaggtagcttgcactagaagggnaggcttatcccg

SEQ ID NO: 44719 - DNA, 1041 bp, Homo sapiens
taagggatatgtcgaccacgccgtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacaggtcagcgagacccttggaaagagggtggtcaagaatgtggaaggtgggcagctttggtgatataattcttatggtggctgtgtagtctgccacaaactcatcgtgtgaacctaggaaagtcacttcatctggctccctgttttatatatacctgatacatgtagtctgaggtaatttcatacaatattttaaataattttgtgcatgaaacaaagcttgtatacattgaatcatcagaaagcaaagggccgggtgcactgctcctggtctatttatttatttttcttttcccatgtactcttcctggaaaggttttgtagcaatttggatttttggattaaggatgctcaacctatggtacattttcattgatagtgaaacagttctaagtgcattgttacttgcccaagcttattgtagttgttcaaatctatggaagatagagtccagctacaatacaagtttccagtgggatacagacagaacatgacttgagagattgataggattgggaacaatctctggaagcctttcttggtgccagatccatagccagttttctcttcttgggcaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacagatgatgtggagaaaggcaagattgaagacacaggagtgatcttctgcaggaccggcta

SEQ ID NO: 44720 - DNA, 201 bp, Homo sapiens
tttgggcgcgtgggttgtgggcgctacagctcacgttaagagccctggaagatgaaaagaaaaagacagacacattgctgtattctgtccttcctccgtctgtgtgtgcgtgcgccttgggacacatgggccctgtgcgccggagggtgggtttcttgcacgtcggcctttcttctggtcagcgtgtccccgcgcccacaa

SEQ ID NO: 44721 - DNA, 3164 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44722 - DNA, 3062 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaaatcatcttactgttttgaaatataatacaa

SEQ ID NO: 44723 - DNA, 3090 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44724 - DNA, 2966 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44725 - DNA, 1705 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgcatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44726 - DNA, 1420 bp, Homo sapiens
aaagaattcttgctaacagaaattaacttctaagtaaagcagtggaaataattgaacattaatgagccaattacaatcataagtactttttaggggatactttagtgatttttgtcctctaatgaaatgaaaaccaacagactggattgagaaggctgctttttttcttgctgttgtggttgttttgctcttcctctgtagtctggctcaaaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44727 - DNA, 569 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggtaacaaacagcaatggagacttctga

SEQ ID NO: 44728 - DNA, 3212 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtctctatacagtttttatttcaataaaaatattaacattaaaaaacatt

SEQ ID NO: 44729 - DNA, 3065 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgtacggatttgtgaatcacgccctggagttgctggtgatccgcaattacggccccgaggtgtgggaagacatcaaaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacactggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44730 - DNA, 3243 bp, Homo sapiens
cgctccagctcgatgctgcctccccggcccggttagcgggtagccgctgccgcctctgcctgggtcccttcggccgtacctctgcgtgggggctgcctccccggctcccggtgcagacaccatgaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagatatctcagtggagtgaaggatgtgctacatgtgctgcttcgctgatctgcccactagactccgatttgactcgttttcatatcttgctttcccagagtctgctgtcattgcgaaagcattgtttattggtctccctttcttctttgctgcagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggtggagactgttggtgacaagtatatgacagtgagtggtttaccagagccatgcattcaccatgcacgatccatctgccacctggccttggacatgatggaaattgctggccaggttcaagtagatggtgaatctgttcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacagatgtcttatgtctccagaaaattcagatccacaattccacttggagcacagaggcccagtgtccatgaagggcaaaaaagaaccaatgcaagtttggtttctatccagaaaaaatacaggaacagaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgt

SEQ ID NO: 44731 - DNA, 1294 bp, Homo sapiens
  misc_feature (1216)..(1216): n is a, c, g, or t
  misc_feature (1236)..(1236): n is a, c, g, or t
  misc_feature (1242)..(1242): n is a, c, g, or t
  misc_feature (1289)..(1290): n is a, c, g, or t
cgctccagctcgatgctgcctccccggcccggttagcgggtagccgctgccgcctctgcctgggtcccttcggccgtacctctgcgtgggggctgcctccccggctcccggtgcagacaccatgaaaagaggcacagttagatgaagaaggacagtttcttgtcagaataatatatgatgactccaaaacttatgatttggttgctgctgcaagcaaagtcctcaatctcaatgctggagaaatcctccaaatgtttgggaagatgtttttcgtcttttgccaagaatctggttatgatacaatcttgcgtgtcctgggctctaatgtcagagaatttctacagatatctcagtggagtgaaggatgtgctacatgtgctgcttcgctgatctgcccactagactccgatttgactcgttttcatatcttgctttcccagagtctgctgtcattgcgaaagcattgtttattggtctccctttcttctttgctgcagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccagctccagcctgggaattgcagccttctgtctgtcttctcgctggttcgtcctcatattgatattagtttccatgggatcctttctcacatcaatactgtttttgtattgagaagcaaggaaggattgttggatgtggagaaattagaatgtgaggatgaactgactgggactgagatcagctgcttacgtctcaagggtcaaatgatctacttacctgaagcagatagcatactttttctatgttcaccaagtggtcatggaaccctggaccaattttggccaaagggaanaaggggctggttatcctaangtgganaattccctcctggcaatggatggccaacggccgccgaattccttggnntccc

SEQ ID NO: 44732 - DNA, 5300 bp, Homo sapiens
cacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactattttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttgggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttcattgtcaacagtggtgtgtcattttatgtatgttcctaatgcttatggaactcctccaaaataaagttactcaaagagagcaaaaaaaaagacagtcaatgagatcagcatcacacaacgcataacacaaacaaagggccc

SEQ ID NO: 44733 - DNA, 5193 bp, Homo sapiens
cacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactattttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttgggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttcattgtcaacagtggtgtgtcattttatgtatgttcctaatgcttatggaactcctccaaaataaagttactcaaagagagcaaa

SEQ ID NO: 44734 - DNA, 5441 bp, Homo sapiens
cagttgatcactctgaagctttttggctaaagcgtttgggtttagagcttccattactcattcgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactattttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttgggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttcattgtcaacagtggtgtgtcattttatgtatgttcctaatgcttatggaactcctccaaaataaagttactcaaagagagcaaa

SEQ ID NO: 44735 - DNA, 550 bp, Homo sapiens
tgaactgccacatgaattaggtaatataaccttaaaaattttaccagatttcatcaaatctaagacttccttaattgtaattgcattcaaatttcagagatgttcaagcataaaaaatggctgatggcaactatagtgtcactaattgtaagatacttcatgatgttaaaatatgaaaaaaaaaatgctccttaagattgatgaaatgttcatttctgtgtggtttcctttgcattcaataacatagttatgctgttataatgaagattatagattatgactggttcactaagtataacttttaaaaagaaatatttcttaaatgccacattttgctgttaatctacttttatttcatataccatgtagactatatttttaaaagaatcagggtaaagtttgtaattacataattgaaagttgtcctagatgtacctaaggcagtctttcttcataaataatagaaagttaatattgatgttcaaaaatgttacctggatggttattaaagatagataggttcttaactcggttactaaccagcactgag

SEQ ID NO: 44736 - DNA, 5243 bp, Homo sapiens
cacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactattttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttgggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttcattgtcaacagtggtgtgtcattttatgtatgttcctaatgcttatggaactcctccaaaataaagttactcaaagagagcaaa

SEQ ID NO: 44737 - DNA, 4901 bp, Homo sapiens
cagttgatcactctgaagctttttggctaaagcgtttgggtttagagcttccattactcattcgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgcattttcataatgattccattactcccagtgagcgtggggagcctagcaatgaaccttcaacagagaccaataaaacccaggaacaatctgatgttaaactgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactattttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttgggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttcattgtcaacagtggtgtgtcattttatgtatgttcctaatgcttatggaactcctccaaaataaagttactcaaagagagcaaa

SEQ ID NO: 44738 - DNA, 4802 bp, Homo sapiens
cagttgatcactctgaagctttttggctaaagcgtttgggtttagagcttccattactcattcgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactattttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttgggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctatctagatttctgaaccaagatatatttatagttcacttttgggtttttatacccacggtaggattctgcattccagcattaaatctgcttcattttagaacctttataaaagcaatagctggaatatactcccagttttaaaataaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttcattgtcaacagtggtgtgtcattttatgtatgttcctaatgcttatggaactcctccaaaataaagttactcaaagagagcaaa

SEQ ID NO: 44739 - DNA, 438 bp, Homo sapiens
gcaataccaagtgttggtaaggatatggagcaacacaactctgatatactgctagcagtgatgtaaatttagtacaatcattttagaaaagaatttagtattttctaataaggttgaagataaatgtattcagtgacctagcggctccattcctacacatataccacttccattcctaagtatatactgtggagaaaagcatgctcatgtgcattgtcctttgggattgtactgtcagaactaaacctgctccctgtcctccaaactccaggggactgtagaaaaacctgccttggcaatgagcggactagaaaaggaaaaagagaggaaaacacatccctgagaagttactgctagaccacttacaaattgttacaacacagactttgagtgggtaggccaaggaatctcaaacagtgaatctcatatagctaatgc

SEQ ID NO: 44740 - DNA, 950 bp, Homo sapiens
gcccagcacatggctgatccccactgagtgttcttttcctcctttgatcccctttggctgacctaggttggagcagccactaaaatatacccagaaacatcttcctaatctacatctgtgccaaccctcattccctggcgcagcatgaccatcacatgcccgccattgttcctgatctctgctgctcatgacctgctctccagcgctccttctcatgctcacattccagttggcctgacctagataagtggaggtttatttgaccccaaaaattagccttctacaaacgaatataatagtgtccattacagagaataaacttagtgcgggtcccatttaagcagaagttactgaaagcctgagtttaagtttccagggcctgaaagttttccatgacagttttctgcataatattaccctacaatttcaatctgttatttaaagccattcttgtggtttgttgtactttggattagctttattttgatttgaagtccttttacattacgggcagttaacgctttgtctctgttagatttgctttttagttcacaagagaaacctcattcctctgtatttgaatagttgcaatgatggaacagctgtccctggagggaaatgaaaacagtgattccccaaattgtgacagatagaaatttgctcttgggttacttacaatgtatctgagtattaaaaaattttctttttaaacgtttgaagtaaaactacccagaaacacttagtggctgaccagaaactaaactcctggcatcctcaaaatgggatttattggcttataaatgtcctgtgttgattcacaaaggcacaaactatctaggtaagttttcttctaaatgttgatgggagagctggccactgttatgcaagtttcattgtcctgactaaactgccaaagagattacataaaattatatcaactagacaaaagg

SEQ ID NO: 44741 - DNA, 458 bp, Homo sapiens
cttcaaactgaagcaagagagagaatcatgcctattaagtccagcacatacagatggaccagcaggtcacacatgggactaatctgattcattttaaaaataaatgcatacattattgaatcattttctacttgcaagatctgttgtgtgcaatattcgaaagagatttaatgttgtttttttcattgccgttttagcaggttctcttccccactccccctgcccactttaatttaacaaccttcccccccaccccccccatggtgctttgaaatgatttttctaatatctgtcattcagtgttgagatccaagctctggagattaattaggtcatgaggctttttctcctcccttctttgtaaagggttttatctccattctctttgtgaagagcatgaactcaatgttcttggaaagagaaatggcctttagaaacagggaagtaggagatcctcc

SEQ ID NO: 44742 - DNA, 716 bp, Homo sapiens
tctagagtgatccctgatgttatgcccaacactaagttagagagaaacccactttaaaagaatgagctgaagatggtcagggctggggctggggtagaactcaaaaggaggctcgaaaaactgtctggtgaacagaaaagattgcacacagagaaatcagagaaagaaaatcacttgaccttgacagggtgtagcgtaagccagagggatgctgggacccagagccggcctctggcactcctactgggcagggctcatgctggccagggctacactgacccaggcagaagtggggctttctctgccttccaaggtaggttcaggtccagggtcaaaaaagggcttgccaagttcctctgcaagcttcattctgaacttccagtgtttttctgacaggaagagtaataagatatgggtaagacaaagccctgtctgctggagctctagcagcagaattaagaaaagaattagttggggttttaattcgcactcttgctgggaacactaccttaggaggaaaaaggtcttcataaaggaaaggaaaacctgtaatcccagtgctttgggaggccaatttagtttcattcttctgaatcaatgtcactcagcttcagtaacacgtaggatcactggctagttttgatctgagacttttaggtagaatacatgtaaactgacagttcaaggaggtctctaaaacctaaggcattccttca

SEQ ID NO: 44743 - DNA, 743 bp, Homo sapiens
tatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatct

SEQ ID NO: 44744 - DNA, 319 bp, Homo sapiens
acatttccaaagtaaatgctcatttttagcacagaatcttttaaagaccttacaatcaaatttatatcacattagtccatttcaacgccatattttctatttatcgttacttctgtgtcctataaaggaaatgatatcattcaacattcaaaagcatcttttaaaaaaattatttttttagtctttctatttgctctttggagtcatataaatttctttattttttcattcttctctttcatgtaaagttgctgattttataatactaagatttcataaaagaaaaagaccttcctctcagacaaatgttctatgtgag

SEQ ID NO: 44745 - DNA, 290 bp, Homo sapiens
tccaaaagtgctgggattacaggcgtgagccactgcgccggcctgatttttttttttaagagatggagtctggctgtgttacccaagctggagtgcagtggctatttataggcacagtcatagtgcactatggcctcaaattcctgggctgaagcaatcctcctacctcagcctctctggactacagacatgcacccttgtgcccagctgtgatttttatattgaaagatgggatcactagaacttgttgaatcatcggaagagttttcatagactcacataactggata

SEQ ID NO: 44746 - DNA, 407 bp, Homo sapiens
ctaaaattccatccaatttttcacaaatgtcagaatctcttttgtttttaaggctgaatagtattctattgtgtatatataccacattttctttattcatctgttaaacgcttaggttgatttcataacttagctattgtgaataatgctgcaatgaacatgagactacagacatcccttcaacaaactgatttcagatgtttggggtaaaacccagaagtgggattgctggatcatatggcaattatatttgtagtttttttgaggaacctctatactgttttccataatggctgtaccaatttacattcctaccaatggtgtgcaagggttcccttttctccacatccttggtaacacttatctttcatcttcttgataaaagatattcagacaaatgagaaatg

SEQ ID NO: 44747 - DNA, 1182 bp, Homo sapiens
tgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgg

SEQ ID NO: 44748 - DNA, 447 bp, Homo sapiens
aaggacactttgtcacttggtttccgtcagtctcctgagaatggggaatttaggtctagcgtggttcacagttctggttttttaggagttatacttgaaagctcaatgtcggacacatagcatgaaatccgtcactggtgctttgcatttgtcttggaaaggacatacgccccgcctgtcccttttactaactagggagactgtgaatattcccaagcccagcaccacgtgcacacgccgccagctggctcgcgcgttttccacggagccctctggaggggagggagcgcggttcggactagcctctcccgaacaccaagtgccgctcttagccccgtccagcccgccctgttcatcgggggcctcgccgcgccagtcgccccggctgccttatgtaggtatgcgcggcgggcgcgtgacgtgggcgcggggccgtgggcggccgcc

SEQ ID NO: 44749 - DNA, 698 bp, Homo sapiens
ttactatgagcacagcatagagaggacagaagatacaagaaaggaagaatcagtagaaaggcttcctctgtgagagaaagcagagagattggagggaattcgctcagggtggggatgctgttaggtccctggaaaggcacctccaactctccagacttaaatcaaagggcgaagaagaggagggtgatagaaaccacagatactgcgggtgcgagagagtctgagaatgtccagtctgatggatgttcagatagattggcctgagatgctgtctggtaataaagattttctgtttgaccaaactttggtcaggctcttctgagtccttttcttgactagaccttgaccttggtctcatcctgactttgggctgcatagcccagtcttaacgaaggatcttgctgaatcattccccaccctagatatctgatcaagttcctcatccctcactttgatgtgtaagtccttagcctgcctttagcaagaattctgtaaggccagtttagcaagagtcccccctactcttaatatctcttcttagtaatttttcatccaccgactccttcactctgctcattgactataaatcctaagctatctctactgtattcagagttgaacccaatgtctttctcctattgcaacagatatcatctctactacagcagtcttgaataaagtcttccttaccattttta

SEQ ID NO: 44750 - DNA, 489 bp, Homo sapiens
aatcaaaaaaaaaaaaaaaaaaaaaaagcgagtgtgcatttaaagcaaacagtagctcaatgggaaataatatttgcatctctattttatctaaagtctatttttaaaaggcctataaaatcataaaagtcatgtggcattatttttcaactttgtaaatggttgcttggcactcattcaattagacaggatagtttaacagcagtgatactatcagcatcatcatcaccatcattgtcatcatcatcatgaccacatcttcattgaaggcctcatatgagatataggtcactgcatcaggtaatggagtttcaaggaggcataaagtcttgaggatcttatcaagttgggacgtcagagtaactacattcataaggtaaatcataatgcaagcctgcatgtgcttaatgctaaatgactgacagtgatattatggagaaatgggcatccctgaggtcaatgtgatgtactctcagaaatatgagtatt

SEQ ID NO: 44751 - DNA, 510 bp, Homo sapiens
gttgagtgaattcttgttcctttcatggctaaaatatgtgaccaccagcccactgaatgaaatggagcgtgtttgaatttgcctcactgtggtcactctggaagcaggctcagcttaccagggccatttctctgatgtacctttggaattcttccaaaatgtatagggagaagtagaaaaaccagaggcattctgagtgaggaaataagcagatgactcagcaaatcaccaatctacttcatctccttgaatagcaaatagttgaatttcatgaagaaactttaattttttctgattatgaaagtcatatacaattgttttaaccaagtgtgcacagaatgatcacacttatagaaaatgtctgttttgttcataagtgaattaaaaaggtcaggaaagatatattccatattatgaacattttttttagaaaatgaaatgggcatgatgattagaaaaatgttgtaagtgctcattgtaggacagtcagataatatataaagatgcaaa

SEQ ID NO: 44752 - DNA, 352 bp, Homo sapiens
tcctttacagtgggcaagaccatcatgatgcccttaagaagacccccaacatcttcttggggaaaaagttggctcttcagagctgtccccaaggctccctcttttagccctcttgcatagggtcatttgcatgagaacagattcctttgtgtaaagttggcctgcctgttctctgtccacgtttatagtccttcaagtcttcgtgttgggttgctaggcagatatgaccctggcttgcaaataagctcactgcatttaccagcctgtgagaacttcaacttgggtaagtagactgaaaggaatctggtctggacctctgggaagagggtcccgcaagcctgcttttgggggc

SEQ ID NO: 44753 - DNA, 242 bp, Homo sapiens
tttttcaaaaagaacccaaaaccacaaataatcccaaaggacaataatcaaaacacattacgcggttcccttcatttcctttgcaacactcctcttgcctagggccactggacttggcaaataaaaatacagaacacccagtaaaatctgaattttaggtaaacaacaaataattttttaatataagtatgtcccatgcaatttaattcaaatcgaactggacatctaatattttatctggc

SEQ ID NO: 44754 - DNA, 281 bp, Homo sapiens
tgaaactaatgagaacaaagatacaacataccagaatctctgggacacagctcagacagtgttacgaggaaagtttatagcactaaatgtccacatcaaaaagttagatatatctcaacttaacaacttaacatcacaactaaaagaactagagaaccaagagaaaaccaacctgaaagttagcagaagacaaggaataaccaaaaacagagctgaactgaaggagattgagacacccccaaaatattcaaaagatcagtaaatccagtagctggtttttt

SEQ ID NO: 44755 - DNA, 277 bp, Homo sapiens
tctccctcagggctcttaaaggcaccagtttttctatggaacttgttacattgttaccagcctctctctccccacccagtgattgcctctgtggagattattaaaagtccagcagggcccgggtgtggtggctcacgcctgtaatcctagcactttgggaggccgaggcgggcggaccacgaggtcaggagattgagaccatcctggctaacacggtgaaaccccatctctactaaaatacaaaaaattagccgggcgtggtggcaggcacctgtag

SEQ ID NO: 44756 - DNA, 405 bp, Homo sapiens
gagatagacccagcctagtcattcatttgtaaaaagtgctaggaatcacgtttaataaatgcttttggatatgataggtgtgaagatggagatatcaacagagcatcatgaaaaaggaacctagggctcaggcatagtggctcacgcctataatcccagcattttagggggctggggtgggaagatcacttgaggggagttcaagaccagcatgggcaacataatgagatcctgtctctaaaaaaaattttgaaaattagccaagtgtagtggcacatacctatagttctagctactcgagaggctgaggtgggaagaccacttgagtccaggagttggaggctgcagtgagctatgactgtgccactgcactttagactgggcaacagagcaaggccttgtctc

SEQ ID NO: 44757 - DNA, 307 bp, Homo sapiens
tcttacgtggcctcgctgcctttaacaagctttctgttgcctgagggggaaaaccacctctgctcttaacctgacccagctaattggccctggggaagtaaattatgtagaaagaagagccctccctgactcttgccacaaatatctcctaactataggagacactgagagtgaccacagccttcttataaatctgttgtggcctcatgacctctgagcaataataaatagtactttcacaggccgtcctgtagatatgaagatgttttgtgagaacatctggcattcattgactcaggaaaagaaa

SEQ ID NO: 44758 - DNA, 422 bp, Homo sapiens
aaattgcaagttggggtcagtgatactaagacttctaatttgtttaagacttcacactggattaaatgcttagggagaagtgaagaccgggaaataggagagaccagattttttttttttttaaactaatagctctgattcctcttaccagtcacttttaagcagatccgctcaaccttgatccttttctagatctcgcgccacaatctgcccccaatccaccccgaatgactcaactccgaattaacagcggacccggcataaacagacaccacactctcacgacgtgagatgactaacaaggactttatctaccaaaatggctagccttgattcaggctactcctctgcttggaaggcaaaatacatcggcagagaagtgaaaggagaaattaaacccagcaggaacacagaatgtgaca

SEQ ID NO: 44759 - DNA, 3067 bp, Homo sapiens
gggcgggcgcgcggccggcccgaggggcggtccctgggctcccgctcgccgccgctgccgctcctcgttctgctcctcactccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattaca

SEQ ID NO: 44760 - DNA, 999 bp, Homo sapiens
gcacgagacctgattgatgtctctcatgtaacatggaaaggaaaaaggagggagggacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattaca

SEQ ID NO: 44761 - DNA, 2233 bp, Homo sapiens
  misc_feature (2233)..(2233): n is a, c, g, or t
gggcgggcgcgcggccggcccgaggggcggtccctgggctcccgctcgccgccgctgccgctcctcgttctgctcctcactccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaaacctggcctcgttggcctcagcggtggagctctgccgccggaan

SEQ ID NO: 44762 - DNA, 2964 bp, Homo sapiens
tttccaaggaaggaaaggcacacaatggtatcaaatgttcattcattccatctcttgatgctctacgatattatcagtctacactatgctttcctgaaaggccagaagttcaaagatggactagtttcccagggacctgattccccagttggaatactccagccccttggaaattcccgggatttataaaataactctagacaacaagactttgtctttaaaggtcctatgaattcttttctctctgtatttaggtatcctgatttttcttttccatattttccacaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattaca

SEQ ID NO: 44763 - DNA, 3394 bp, Homo sapiens
gggcgggcgcgcggccggcccgaggggcggtccctgggctcccgctcgccgccgctgccgctcctcgttctgctcctcactccccagcggctggaggccggtaccggcgggcaggaggcgcccgaggatgtgctgctggccgctgctcctgctgtgggggctgctccccgggacggcggcggggggctcgggccgaacctatccgcaccggaccctcctggactcggagggcaagtactggctgggctggagccagcggggcagccagatcgccttccgcctccaggtgcgcactgcaggctacgtgggcttcggcttctcgcccaccggggccatggcgtccgccgacatcgtcgtgggcggggtggcccacgggcggccctacctccaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtcccaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatcttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatcttgttttatgtcctgtcctcatctcttaagctaaatctgtttggatcatattaataaactaaatgaaattacaaaaaaaaaaaaaaaaaaaaaaaaaaaaaaaaaaaaaaaaaaaaaaaaaaaaaacaaaaaaaaagagacaaaaaaaaagaaaaaaaagaaaagagaggaaggagaacaaacaaaacaggacgacaacaccagcatcaccgcaacccaggacgagagagatcaagcaaagaaggcgcgacagcggcgagcgcgcacagcgggagaggacagaaaaaagaaaaggaagagagaagaaaagaacacggaagagaagaaaaaggacagaccgcgcgagcgacgagcgaacacgagaaagagagagaagagagcaaagcaacacagtggcgca

SEQ ID NO: 44764 - DNA, 396 bp, Homo sapiens
ttatttttctggcattgtcagggggaaatagaatttttaaatttattacaaaaatatgcttatcatttgtctaggtatttgtcttcctagacaatattttgaggttggtgtaaaataaatatctaatacttcaaagagagcccatagagttggaaagatttattttgatttacaaaatactctcttttgatattttttattttagatgactgatactggcattttcttctatttaattgttgttttacttctgagtagtttttttttaatatttgttgggggtagaaaaagaaagaatattgctaaagagtttgctagatgtatgagatggtaggaggaaataaaggcaatagcacttatgcttaagcaagtagagatgttttttaaaagcaagtg

SEQ ID NO: 44765 - DNA, 341 bp, Homo sapiens
taaccaagtccttcagctgacctctacagaggtcactgccagccttggcatgggaggaggcagctgcctccctctttgtccctcctctggcattttctccattataattcctgccatgtctggtttacattcgtcatctatgacacagcttggcagcagagggaagtgaagtggaggcttggagccctcagctgaatgattctagtctagaaacctgtgaactgggggtgctggcctgtggtctagactgtgtatgtttttacttctctgggcccttgcaggtacaaactatacctatggatgtgagagcagaaagatgatcatttataaataaaatattt

SEQ ID NO: 44766 - DNA, 379 bp, Homo sapiens
gatgctcttggaacactgaaaaatcttagaaaattttgttaaataataattaaaattgtcttaaattagtgtgacatctatgttaaaggcaatataattagatagcgtgcttcttcaagtgcttgggttaggagaagtatttcaccatcttcattcatcaagcatttaacaattttatatgatgtgccagatatcatgttataccttggtgataatacatgcctaagacaaatttcctgtctatgaagtttggaatctagttgaaggagacaggcgtgatgaaagaaataaagcactgtagaagtaggataaaaatccgcatttaggggactgctggcagctcaaagcagactggagatatgggagaaagagaagctga

SEQ ID NO: 44767 - DNA, 393 bp, Homo sapiens
ttttttgccaaaatcttcactgcatgattttgcaggctcacatgcttcttgtttgccattttaaatcacagtccccatcaaatgcccattatctttaataaggtgaagcaagaggctgggtgcttggctcacatctgtaatcccaacactctgggaggcctagcaggaggattgcttgagctcgggagttcaagaccagcctgaacaacatagtgagaccctgtttctaccaaaaataattaaaatatacagatatagtggtgcacatgggtggtcccatctacttggatggctgaggtaggaggatcgcttgagtcttggaggtcaaggctgcagtgagccatgatcacaccactgcactccatactgtgtgacagagcaagactatgtctc

SEQ ID NO: 44768 - DNA, 309 bp, Homo sapiens
tgacctgtttacttttatagcctgtctttactttgtttcttttaatattatacatgtttaggctatgctttttctttaaatatgtgagcaaatctattggtgtaatgtactcattaccctaaaacctatattataatggacccgaataccataaggtagaagatcagaagaaaaagaaaatgcatacatttttatctttaaaacaattcacttttaagattattttcttgaaaggtatacgtttgatggagctgaatctagttccttcaggcagatataataggatacaataggataggacttcttggg

SEQ ID NO: 44769 - DNA, 801 bp, Homo sapiens
tttagtaagatggatttcagtatgagaagatgcttctggatttagtgaggtttggaaataaaggaacagcccctcttgtcttcaaatacttgcatgatccatgccaaatatgggaatattacacctcccatctttccttcccatatgttaccgtcctagaagatcccccattgtcacagtggccctttattccttctccttccctccagctctgccttagcagaggtgtagtggaagaagtgaagaattaggaatgtgggggttcatccctggaactgtagcatttttgttagaatgtgtttttgtgtagaaacactgttaaatgaataataggttacatgatgctataagcagtcagtggctggttaggatatttaagcatatttcaaaatcaaagtattccattgtcttctctctcttcttcctactaaagatgaacccccttgatgagcagataggccctgtgaaagatggcctccaggtgatgtcagctcactgtgatgcacacctggaggaaggggctctcttatctttatctgggtgtcagcaggtattattagcctagtgcctggcacagaggacacgcccagagatccttgttgaatttggttgagttgaagaaagaaaaacttttactttctccatttccattcttggcagtttctcaagaaatgtctttttcgagacaggctcttgtgccatattttacaggctgggcgcaagctcctgggcttaagcagtcctcgtgcctcagcctcccaagtagctgggattacagctagaacttatgtgaaactcaag

SEQ ID NO: 44770 - DNA, 320 bp, Homo sapiens
caccagaccacgtggaggagcagctgaaacagggccggtggcagcagccgcctgtgagacgtgccagccggtgagccttgttagtttaccattgccacggcaagacccagaagttactgccacttcccacggtaaaatcccaatgaccctgaggtttctgctccttttctagaaatttctgcataaaccaacccctaattagcatgtagttaaaagtgggtgtaattatgatgcggagctgcctctgagctgctcttctgtgcactctgctctcctggggcagcccctctgctgccgctgcaataaaagctgctaacagc

SEQ ID NO: 44771 - DNA, 416 bp, Homo sapiens
cacactggctggctgaggtccctccctggctgggcctcttgcccccaccgtctgctgcatctgcatctgcaggacaggggccagacctcagcgctgctgcctgtccactcctgcccctgagcagtccatccttgttcttggcagggagcagatctcagggccacagctccagcttttctcctgcaaggcctggccagctctgtggctgtacttgtgcccagagagacaggtggcagcggcagagttaggcacacctggccgtgagccacacccaccttgtgctccccgtgtctcctgggcttgttaccgcccactcaggcctctgttttcccatttgtggagcaaggggtaatagcagatcctgtctctggggcagttttcccaatctattgtggtaagggtgtatagtcctcagt

SEQ ID NO: 44772 - DNA, 501 bp, Homo sapiens
gtgtgagactttgcactcactatctcgccggccggactgcatgcccagggtcagtagtcagcagagctaaaggtgcccgaatttagcacagctggctgtggtgcctgacatagggcagtaccgggggattcttcagaggtcagccaagtcggtaacattctgtgaagcagattaaatacagtaaaatcaaacaaacggaggtctttggaagtgatgctgggcccaggcagtgaaaatcaagaaaagaggagaaagaccaagacctggatgtcctggacgacctgacccaaaaaggggcacaaagcagcagagcttcaccaggtgactgggtggcttctttgtcctcattaaatgtacatctttgcatgaaaaggaccttgactggtccggactttaacaaagtaaaatatgaagaaacgtaaaattatgcttctgaaaaatatactgaaataaaattttgtaaatagctaaaagaaaaataaataaatataataacaagta

SEQ ID NO: 44773 - DNA, 389 bp, Homo sapiens
agggtgtatatgtacatatgttcatacatatactatcgtgaactcactggttctctctcccttgaaaagcaaagcaaactgattaacattagccgctaaacaaaacaaaattagaaaagctggcgatgaaataacaatgcacagaattctaaaaccaaataaaaatctctgcttatgtcagaataatggggagttgtttagtgttgtaaacttcccgaacactccatatcctgaacagttaactcttcagttaacttttttgctagtccagcatacccacagagcttaggaattgtcatccgtgtgacctcagcatttgttggaattggcccctaaagaagtaattcaaacagtggtcttacctcaactgttttctaactggtaagatc

SEQ ID NO: 44774 - DNA, 472 bp, Homo sapiens
tgaatattgagaggattaaatgaggcaattcacctaaggtgattagaataatgccggacacagagcaaatgcacataaacattagttgtttttattacatgtaattctcatgagatgaaatcctatacgagtggttctcaaccaatcttgccccagggtccatttgacaatgtctggagacagttttggaactaaggcgacggttagtgctgctggcatttagtgccgggaggccaaggatgctactaaatatcctacaacatacaggtcacacacacacacactacagagaattatcctgcccaaaatgactgactacagtgccaagtttgagaaatcctgtcatttaagtcagtatggtggttgtcccattttacagataaggaaactgaggttcaaagaggtgaagggattagctcaaaatcacatgaccaaagaaatggcagatctggaatctatcccaaggcaatcc

SEQ ID NO: 44775 - DNA, 411 bp, Homo sapiens
gccctttctaggggcaaaggaaaagtcagagctgggtaactgattcctggagatgtactggtattcaagaaagaatttacctgctatggagatagtattccaggaggtaaacttttgtttattatctcccttggagataaacaagtttccactataaccattattagcacccagtgctcgttctgtctctgctgccaattcattcattcattcagttatttaacatgtcatcattcacacattatcatatctactgtcctccagacttctgctctggtagaagtagaggacacaggctgggcacggtggctcatgcctgtaatgccagcattttgggaggccgaggcgggcggatcacaaggtcaggaattcgaggccagcctggccaacatggtgaaaccctgtctctac

SEQ ID NO: 44776 - DNA, 424 bp, Homo sapiens
gaagacagggtctcattctgtcacccaggctggagtgcagtagtgcaataacggctcactgcagccttgacctcctgggctcaagccatcctcctgcctcagcctcctgagcacgtaggaccacaggtaccacgcccagttaatttgtgtgtgtgtgtgtgtgttagacacagggtctcactttgctgcccaggctggtcttgaactcctgggctcaagcaatcctcctacctcagcttcccaaagggtagggattacaggtgggagccacaatcattttaattgattaaaatgatttaattatttttaaaattaaagactgatattaatccttttctttggtctgacaaaaggcaatgggaattccccaaaagctaaatgaaacatcttaggcagagcagaacacaatagtcttttgagaagt

SEQ ID NO: 44777 - DNA, 435 bp, Homo sapiens
actaaggattcgaatccacattggtctcagtcttacatcagtgctcttattggagccatcgggggctgagtctgggaggttgcactccctaccacttgttccagacatggttgcaatgtaatgtggcagcaagctagcattctcttcccaatagctcggacgtgaagccctgttggaggggaccatggtgtccaggtctgccccacacagggtggccctgcttacgacttcctgtcctgtacccacaagggtcccagtctccttgggagtgtcctgtgaagaggaaaccacattccaggcccagatgcagacagctgtgtgcttcctccagcctgtggtgactcatactgggacaagaaagccgcttctttgcctggattccctgtcccaaaaccctaatctggggaaagctgccttaagctccctaaacacaag

SEQ ID NO: 44778 - DNA, 413 bp, Homo sapiens
gctcctcccctgtgtaaggtgcaaattccccatggctccacccatttcccccagtgcgcaagtcaggctccattctgctgtgggcatgcccagacaagccctgggcaggtttcctcgtctacacaaaagcatctgacgtaaatacttatggggtgggtcagagattctccggagacccctttttatctgcctaggtatttggctgtctcactatcctaaggcattcatcttcatgacagagtaatacagaaagacaaatttatagcacaaagtataccggattcactagagtagccactccacttaacacccaatattgaactggtaaggctcaaacttgccctgagatggggccccatcatgtttaatccaacctccaaccaggagattcaacatgttgtctgtgggcaaga

SEQ ID NO: 44779 - DNA, 287 bp, Homo sapiens
gcgggcgcctgtagtcccagctactcgggaggctgaggcaggacaatggcgtgaacctgggcggcagagcttgcggtaagccgagatcacgccacagcactccagcctgggcgacagagcgagactcagtctcaaaaaaaaaaaataaaaataaagaacaaactggggagaaaacatgtcttactcatagcctaagacaaagaattaatttttctaatattaaagagttcctacaaaatagtaatttaaaaaatatctacaagctccttccccacaaaagatcaaca

SEQ ID NO: 44780 - DNA, 340 bp, Homo sapiens
gattcgcctgccttggcctcccaaagtctttgctgggattacaggtgtgagccaccacgcctggccgctctaggatttctttccgttgacaaccgtgaatctgaagtatgagtcttgtcctgttgttacagggtaatactcttgtcaggtccatgtgtagaagtcttatactgttgtcagagaatgtagctctattgtgtttttcaccatagattatagccttaaccttttaactgttagtgtcactaatatacagttgattaaaatgaggcaagatagcctcatcatcagtgtaaactaacccattatcctgtgaattttcagcaacaatttctttttt

SEQ ID NO: 44781 - DNA, 592 bp, Homo sapiens
tcctcgagagacattagaaagagttcagcctctcactcagtttccatttggtgctttttcttttctaaaaataaacgaccacatgggcccaccgcacacagctaccaggcctgctctccaccaggcaagttccttgcaccttgaaatgcaagccctaagagccttaaggttcttagttaagaaaagaaaaaaaaaattaagcgagaagtggtggggttctctttctccctttcaaagggattgcctaagttctgctgcatcaccgtggcagcagtcctgagttacagacttcctgtgctccgtgtgccctccccgaggtgcagcactcaaatcctgatgagaatttgtctctgtttttttgcaggagtcagaacagagcaagatctgtatgttcgcctcatagattcaatgaccaaacaggtgagaaagtttatgcctctgcacgagttttcactgctgggcctgggttgtcctgggcttcagaggcaagggcactgacaaatggatctcgtgtatttgttttccattgagtttccttgacatgctaatgagaattccatatttattggaatgaatgaagcgattggtaaaa

SEQ ID NO: 44782 - DNA, 477 bp, Homo sapiens
atgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatc

SEQ ID NO: 44783 - DNA, 443 bp, Homo sapiens
atgtttgggattcaggagaatattccgcgcggggggacgaccatgaaggaggagccgctgggcagcggcatgaacccggtgcgctcgtggatgcacacggcgggcgtggtggacgccaacacggccgcccagagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatc

SEQ ID NO: 44784 - DNA, 408 bp, Homo sapiens
gcttcatattcaatccaccacctttttagccacattttctcttctgctgtttgtgctagaagttgttgctgttgggcttctctgtgttttgccataaattggagcaagttccaagcaccaactaccttcctcttctcattttctgctgcttttgcaagttggtccacaggctcaattaaaccaccaactatttctgaaatggactgattttgcccacaaaatccatgcagtcttccttggggtccctggtctgctacgtaacctcagggtcccgcacccaggcttgctcagctcatcaaaacacagtcctgcttcacccaggctgtcctggcctgtttcccttccagcttccccgcagaagagtgattctgctctgcagggtgacagtggcggccagaggaggtgtgt

SEQ ID NO: 44785 - DNA, 784 bp, Homo sapiens
aggcaggcgtccccggcgaatgataggtggcctttttgatccttacgtctgccgcactgtctggctcgcttttgccctaaaatcaaagctctaggctaatcgctaaacaaatacagctcctgagcgagcactccactgctgccttcctatctcttgcggggtgaggaagtcgaagtgactcatttgttttttaaaagtggtttagaataccctagaagtcacttttagtaaatcgatgccagagtgacagatggctgtttgctaacttccagggacttttcatcttaagtgtcccagcgctctctgaactgagagcagtcccacctatgtgagtgacactgggctctgagaaccgctgcagagcgccagggggaaaatgcatgctcttgcttcaaaaagtgtcctatagtgaatctgcaggaaaaaggaggaaaaggattcagggctttcttggagagaagccctcgttgaggtacaaatagccctcgccagacctgagtgagctgctgaaagaggtggtattccaagcctgccacaccaactcacaaaaatgcagttttcactctggggcacaatgcctcacagcatcatgaaggcaggataccctgttgattttccaagtcctttttaatcttcctgcatttagactgcccaacaaaatttcccaaataaacgtctaaattttagagttgggaagagctgtttctctgtgcagtgtatgtgccttccttcatgtccaaacctcgctgtttgttcacctaaaatatataatttcttgaccaca

SEQ ID NO: 44786 - DNA, 529 bp, Homo sapiens
tgaggtgattagtttacttctaggtggaaaaagagaggactttgaacttggtgttgtcacaggagctgctctcatggacaagagcccatggattttgtggaggaagaatgtgtaggaaacaaggagaaaaatcagaagactttgcacctgtcagggaagaactagtgaagagcaaaaaccagtgttttagtggatgaaatacagttccgagggtttggaattagggaagagatggcctcagagaggagcatggagaccatgggaggtagacctgacttgatacttgttggccattttaagaaccaggtatgtgtgaagccttaccacagggatcagaggagcaggagcagttgatggtgactctgtatttaaccatttgagaaactgccaaactgttctctaaagtggctgtaccattttacatgtctaccagcagtgtataagagttccagtatctgcatccttgtcaacacttgttattgtctttttaaagttattaaagccattctgttgggtgtgaaaaaaaaac

SEQ ID NO: 44787 - DNA, 314 bp, Homo sapiens
atctcttgaacccgggagttggagactgcagtcaactatgatcgtgccactgcactccagcctgggtgacagagtgagactctgtctctaaaaaaaaatgtaaaaggagacaaaaacacttttctggagccttccaactagatagttctactagccccagcgcgggagcttcaggccctgtgaaattacgctttgagcgacgaccaaaaatctcttcacagtcctttaaaaccctactaagctctcgggaaggcaccatcatgtgccaagtcctgcagccgtcagcaatgaacacactgagcgtgaaacacaaa

SEQ ID NO: 44788 - DNA, 1850 bp, Homo sapiens
  misc_feature (651)..(651): n is a, c, g, or t
  misc_feature (713)..(713): n is a, c, g, or t
  misc_feature (1844)..(1846): n is a, c, g, or t
  misc_feature (1848)..(1850): n is a, c, g, or t
ctgacctgctgggctgggacagcacaggacccacagatatctgctgccatccacactctccagattggtgtcctgggaccacgtggggatgctgctgtggcttcttgtcttctctgctctgggtatccaggcctggggtgattcctcctggaacaaaacacaagctaaacaggtatcagaggggctccagtacctatttgagaacatctcccagctcactgaaaaagatgtctccaccacggtctctcgcaaggcatggggggcagaagctgttggctgcagtattcagctgaccacgccagtgaatgtccttgttatacaccatgtccctggactggagtgtcacgaccagacagtctgcagccagagactgcgggaactgcaggcccatcatgtccacaacaacagtgggtgtgatgtggcctacaacttcctggttggggatgatggcagggtgtatgaaggtgttggctggaatatccaaggagtgcacacccaaggctacaacaacatctccctgggctttgccttcttcggcactaagaaaggccacagtcccagccctgctgccctgtcggccatggaaaacctaatcacctatgctgtccagaagggccacctgtcatccagttatgttcagccacttcttgngaaaggcgagaactgcctggcccctcggcagaagacaagcctgaagaaggcttgccccggcnttgtcccacggtctgtgtggggagccagggagacccactgtcccaggatgactctcccagcgaagtatggcatcattatccacactgccgggaggacctgcaacatttctgatgagtgccgcctgctggtccgggacatccagtctttctacatagacaggctcaagtcatgcgacattggttataacttcctggtgggccaggatggcgccatttatgaaggggtgggctggaatgtccaaggctcctccacccctggctacgatgacattgccctgggcattaccttcatgggcaccttcacaggtataccacccaatgctgcagcactagaggcagcccaagacctgatccagtgtgccatggtcaaagggtacctgactcccaactacctgctggtgggccacagtgatgtggcccgaaccttgtctcctgggcaggctttgtacaacatcatcagcacctggcctcatttcaaacactgagagaagccccaggtccttctgagactgctttccctcccctgtcaggtctctcctgtcctaaccatccagcttggctcaacaccttttgccctcctcccctgccacacagtcctgtgcctcctttttcaggttgggatgatcatgcctctcctgccaacatcctccaagggcctccaaactcatagctggacattcacagccctctgagtctgagtccagatttcttctctccttaccttcctctcccttggaaacccaactcctcagccaggtgagacaatgggctggttcttgtttcatttctctctctctctccattcccctctgcctggtgagccttcccctggtgtctgcctggcagcccccacctcccacctatcacccctcacccataactcaggtcaacgtgaccacccttccttgcttacacataaacttgtatatatttggatgtagcccttatttaatggctgtcattatttatagatatgtctatccttgctacttggttgtgagtttctccaggggaggaactgtgttttattcatctctatgtcctctgtttctcagcagtgtctgaaatttaatgggttctactgatgtttattagagaaatggatgaataaatgaatgaagagatccaaannnannn

SEQ ID NO: 44789 - DNA, 577 bp, Homo sapiens
ctgacctgctgggctgggacagcacaggacccacagatatctgctgccatccacactctccagattggtgtcctgggaccacgtggggatgctgctgtggcttcttgtcttctctgctctgggtatccaggcctggggtgattcctcctggaacaaaacacaagctaaacaggtatcagaggggctccagtacctatttgagaacatctcccagctcactgaaaaagatgtctccaccacggtctctcgcaaggcatggggggcagaagctgttggctgcagtattcagctgaccacgccagtgaatgtccttgttatacaccatgtccctggactggagtgtcacgaccagacagtctgcagccagagactgcgggaactgcaggcccatcatgtccacaacaacagtgggtgtgatgtggcctacaagtaagagctgggtctgggtcccacggcacatggtcagtgttgcttccctgggatgcttctcctgtcccttctcatcccttttcctcattttctgggttgtggtcctatatgttttataatgaataaaatatttaaaacccccatgaaa

SEQ ID NO: 44790 - DNA, 336 bp, Homo sapiens
agagatgatctctttctgtctcctctccgccatgtgaggacggcaagaaggtggccttctgcaaatggggatgagtcctcaccaggtgtgggatctgccagcacctcgatcttgggcttcccagcctcagtactgtaagaagtaagtgtctgttgtttaagccaccccatgtaatataattttgttatagcagcctacattgattaagacagatgctgtaaccccagctactgaggaggctgagttaggagaattgcttgagcccgggaggcagtggttgtggtgagccgagatcaagccactgcactccagcctgggtgacagagcgagactgca

SEQ ID NO: 44791 - DNA, 478 bp, Homo sapiens
tatgcactaaatgtgatttgtttagaaggtaaaattcttgcattactatattatgatttctttagaatgtataatttttgcattacatttattgtaacatttcaaagtttataaactgtcatggagattaatacagatgatgaatttgttttctgtaactcccttctgaagtacatattatcctcacattataaattaggcaactgaggttctaccaagatatttgaatttactaaggtttactcagccaataaagtaatttaaattttatatgtaactttagaggaaaacatattaatagaaaatgattatttaagaaaaaattcttgaactaggctttgattaaagagatcattgcaggctgggcacagtggctcatgcctataatcccagcattttaggaggccaaggcaggaggatcgcttgagaccagcagctcgagaccagcataggcaacacagtgagaccctgtctctac

SEQ ID NO: 44792 - DNA, 752 bp, Homo sapiens
accccaccaccaccagtataaaatgtcccgaaattttcaatgtacatgaattttggtaacattaaatctgtaactaatttgttttgtcactaaaactttcagaaaagatatattttaatattacacttattaataagcgttttgtacattcattcacaatggatgacttttttttttgagacagagtcgccctgtcgcccaggctgattgtataactaactgcacgtcactcataaataagtatctgtgaatacaaagaatggtaattaattttctcattttgaatcagacatatgtaactgccagttacagatacttaatagtttaacatttattgtgagtgcctactatatgccacgcatgctaaaatatttgatgataaaaggacaaataacagaaggtcagggttcatgcctttttctttttttcctgaaatgttaacacttatttattctctgtgatgggtacacataaatcaatcccagcactttgggaggccaaggcgggcggatcacgaggtcaggagatcaagaccatcctggctaacatggtgaaaccccatctctactgaaaatacaaaaacaaaattagctgggtgtggtagcagacgcctgtagtgccagctactcgggaggctgaggcgggagaatggcgtgaacccaggagacggaggttacagtgacccaagatcgcaccattgcacttcagcctgggcgacagagtaagacccatctcataaaaaattaatacaa

SEQ ID NO: 44793 - DNA, 616 bp, Homo sapiens
accccaccaccaccagtataaaatgtcccgaaattttcaatgtacatgaattttggtaacattaaatctgtaactaatttgttttgtcactaaaactttcagaaaagatatattttaatattacacttattaataagcgttttgtacattcattcacaatggatgacttttttttttgagacagagtcgccctgtcgcccaggctgattgtataactaactgcacgtcactcataaataagtatctgtgaatacaaagaatggtaattaattttctcattttgaatcagacatatgtaactgccagttacagatacttaatagtttaacatttattgtgagtgcctactatatgccacgcatgctaaaatatttgatgataaaaggacaaataacagaaggtcagggttcatgcctttttctttttttcctgaaatgttaacacttatttattctctgtgatgggtacacataaatcttttatatgactctacatttttctgtatgtttgacacatttcataattaaaactacaaattcaaaccaaagaaaaaggtagttgtaataaaatcctttaaaccaccagaagccaatttatgtacaataacttactgaac

SEQ ID NO: 44794 - DNA, 541 bp, Homo sapiens
  misc_feature (69)..(69): n is a, c, g, or t
caaaacaaaccggcttgtttcctcccttggcagctaactctcccggcagcccggctctggggcggaagnagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaaaaaaaaaa

SEQ ID NO: 44795 - DNA, 389 bp, Homo sapiens
taacctcttcctatctcttggaccttgtcttaggccactttccctccccactcaatttctaacactctgacctcactgcttctcaaacagctctttgttgcctcttgtcctttttgtggaaaaggccttcctactgcttaaccattaggcattcttcgattccttctcattcttcattcttgagaaaggccttccttgaccctttatatcaattaggattcttttgggcgagatctgatccaaactggcttagagaaaaggagtcaactgactggttcatgtaattcaacctccttcctctgctgcaaccttcccttggctcccatctcacttaaggtcaaagccagggtccttaccatggccttgtaggcttcacacagtttgtctcc

SEQ ID NO: 44796 - DNA, 358 bp, Homo sapiens
atgtttggatgtgaaaccacttgagggccagagatggaaggggtagtggacattaggtagtgaacataagctagcctggaccccggagccccagcaacactagctgtttgactttgggcagggcaattatcctctatggtctcgtttcctcctctgtgtccaagaatgatgttaatgatgcctgagaggtgtacctctcaggggggttaaaaagatcaaaatgaataacaaatattacagtgcacagtaacgcccaaatgcaatacaatgtaagaaattccttgtgttcactgttgtatcccctaaggtgcttagtgccatgcctcacattacagtggatctatttctcgaattgata

SEQ ID NO: 44797 - DNA, 520 bp, Homo sapiens
caggtgctgcccatggcgggtgtacattgtcaggccggctgggccccagcgcctcaaacaatcccctgtgaattggatttgggaacgtagagaggccgcagccgtgagaggacgtcaggttgcttttcttttcttcttttttttcatgcacaaaaccctcccagtgaatattttcaacggatctgagtggtttctcttacacgtgttggacaaatggttttgagtattcatcagatgggatctatgaagaatcaatcgtgattgtaagatgatttgaaaaatcaagttgccctctgccactaattcaatcttgcccgtaaaagtgtctgaatgtgcagcagagaatttcagggaatttcattgcctcgtggggtgataacagctttaaatattaattgtctatggttaattatggcagagtagcatgaaagagccatatttttaaaggaatgtttgtgctataaattctttttctaggaatcacatcatatagagggactgtcccagaaaaatacagtat

SEQ ID NO: 44798 - DNA, 233 bp, Homo sapiens
atgcctcgccctgcttcggctcacgcttggtgcgctgcacccactgtccaacaatccccagtgagatgaaccccgtacctcagttggaaatgcagaaatcacccgtcttctgcgtcactcatgctggaagctgtagactggagctgttcctattcagccatcttggctccacccccactttttaaaaattttaactgtgcacatagattgcttatttttaaatgaaatttgga

SEQ ID NO: 44799 - DNA, 462 bp, Homo sapiens
  misc_feature (401)..(401): n is a, c, g, or t
gagctggcatgtgcaaagatcacatctcaagaaaggaagcaaaagggaaggggagggaaggtgccaggctctttaaacaaccagcttttaggaacagagcaagaattcactcactcccaagggatggcactaatctattcatgagggatctgccctcatgaccccaacattaggcctcacctcccaacaccaccataccagggatcaaattttaacatgagctttggtggggacaaaccaaccatagcaggtaatttccatttggggctatcagttcagcctcagaagttttttaattagtagttgagaaaggtggtgggaagaggagtcatacttctgtttatggacatcagtggacacatacagtctctacaatgagtggaatattctaaaggaaactngattaaggaaattcagaggaaaacatttttaattcaaagttcagtgaattaatgtaaaagg

SEQ ID NO: 44800 - DNA, 568 bp, Homo sapiens
cgaacccaccagaaggaagaaactccgaacacgtccgaacatcagaaggaacaaactccagacgcgacaccttaagagctgtaacactcaccgcgagggtccgcggcttcattcttgaagtcagtgagaccaagaacccactaattccggacacaatttgactggtagttaatcaataaccagggagattagcgtgctaaccagttaggtgagcattcggcatctcccaatttagacaaatggcattcagccatctgagattgagcagttaggctctggattgcccagctggttagcacacagatagatctctccaccagcctagaaaaggcatgcaccccactcacagaagagtagccacaggcctgtgatgctcttaaatgcctgtaaccacgcaccacactgctctcggcatgtgctcacttgaatccgatggatgtcagagacccgttaagtgcattagtgatggggatcgggattgtagtaagtcgtcgttaaggaagaatttcccggttcccggtgggaagtcgacttcccaccgggagcccaagaggaaatccgaggggga

SEQ ID NO: 44801 - DNA, 407 bp, Homo sapiens
ctttccactgtgtcttggctttcttggtcctagtacctttcacttgtgacccatatgtgaggtggagatcttgcagttcaagtgatgaatccattggcccttacctgaagcatctttgcagtgggatgcttttgcagttctgctgttagatgctgagtcccatgcaggaactgcattgccgatgttgcatttggaaagacagtggggagtactggtaaggaacacacatgctggagtgagaccgggtgagcactgagcgaaagtcaacagtgctgcttacatgatccttctctctcagtatactgacaacccccctgggaagagtaacctgaactcgtcacttctacctccttcaagtcctggcaccactacttacaaactgttacgttgctccatgcctcagtttc

SEQ ID NO: 44802 - DNA, 680 bp, Homo sapiens
gagaacaccttccaaaagccataaaactaattattttggcctaaaccaaaagtgagtttttccttttcccagactcctgataaatgctttgttatcagccaactctctgaaaagaattttctttgcaattccactcacttttcttttgacaacaggggtctcgtttttcacaggagaagcacttctctctgttcttaacccacgtacttctcatggagttgaacgcatcctcagttccagggatgagcaggtgacttaagcctaacaaattagatcagtaccctacactagctcatcgtcattgctttatacttgagcacaagacccaattagacccagctaaacacagagattttattgaggtggtgagagaagagaccattctcttttctgctggaaatgctagcagtacagatatttgagctgggcttccagaagtcattgagtgaaaacagagaatgaaaacaccccagtagaacacagaacaaagacatagagagaaaatgagtgctgatgacatgtttgcactcttggcaccagttgtgtctgaagctacttatgtccctggacttcacagttatacaagcaaataaatgcgcttactttccctcagccaatttgatttgtgtttttatctcttgtaattgagagtcctaattaaaacaggaataaacagaata

SEQ ID NO: 44803 - DNA, 670 bp, Homo sapiens
tcctatctttaacttcttcgtgcatggatcagaggggcctccagtcactgctgagtcacagggataagcaaaaagggaatgacacacttcctgccccaagttctagggagtttttatggtttgtttttctgtttcgctttgaaaattccctgaaaagacagaagattgccccagccgcctcctgattggcagcctctatttatttatatgatttcatgggatatcctctctgctatgccttgtaactcacagggtttttgaaaccttttttccttatcacagcagtattacatgtttgtgtagtgtatttatcaactacaatttgaccaataaaaaaaaaagaggcactccttattgtcactacccagaaaaaaatatattgtgcatatcatcattccaggcgcttttctgtgtgcttatagttttctctttaaaaattatatatggcttaatataatttctttgcttttatatattgttttgtagcctttgtgaagagttctcatgttattaatactctgcaagatcggttttaaagattgcattactggccagccgcagtggctcacacctgtaatcctagccctttgggaggctgaggcaggagaattgcttgaggccaatggttcaagaccaacttggccaacatagcaagaccctgtctcttaaa

SEQ ID NO: 44804 - DNA, 457 bp, Homo sapiens
ggatatccttttacctttctgtatgcaaatagtaacgtaaatggacacaccattctgcacgtgcgcattttctcttttcagtgtattttggaaatcattcctatcattccataaagaacctcctcgttctggtccccatctctctggcacttgttttatgatttctcagtggttactgatagcagttcacagcctcattcccaagttatctccgtgtttggggtttaatttccctgggccaggatatttacattcatgagatggtttccttggactttagtttcctcccactaaggtttgagctacactttgcaaatgggcaaagaccatttttggatgtatatgcctgagggaagacagaaaaacaaagctgaaagagcatccagagggtttgccttcaccatcggaaaccactcagctccttttcagggctagcttttcagactgctttccgaga

SEQ ID NO: 44805 - DNA, 467 bp, Homo sapiens
  misc_feature (346)..(346): n is a, c, g, or t
  misc_feature (405)..(405): n is a, c, g, or t
  misc_feature (420)..(420): n is a, c, g, or t
  misc_feature (433)..(433): n is a, c, g, or t
  misc_feature (459)..(459): n is a, c, g, or t
tataatttaaacattttcaagataagatagcagactattttatgatatagaagcattagcttaacaaatattatattgatttatgtttctttaaagaatgcccttagtttacttgtagctaattaatcttcaagaaaagtgagctcatgctggccagacatggtagctcacacctgtaatcccaaagtgttgggattacaggtgtgagccactgcgcccggccttcatgcattttaaatagttaattctgagacatggaattattggtcaatggatacaaatacccacctcccatggttgtgttcattttattgatgtacactaatgaggaatataatatttattnagtctttcctcattggggatttctaacattggggaaacacaagggcgggcccctttttnccctcccattacccnaaaggggtcattnattattctcttcaaggggttttttanaattggtg

SEQ ID NO: 44806 - DNA, 382 bp, Homo sapiens
gaactgagatttcagttttgactcagcacagaatatttttacatagatagaacgcagcagagaatgtattttggtaccaaatactagtctagcctcactctgctaaccctagatcctatttttactactgctcataaaaaaattaattgatttcctaaagaattcatgttatgcattattctttttttctggccttattgctattcatcagaactatctcacaaactttaatgactccgatgcaaaatgctgacgtgtttagtgctggaaaacagcaacaaaatatggaatacattatactcactgacctgggaatgcagaaagctatggcaatcaaaccttctgagttctctataaataaaacatctttatcttatttgat

SEQ ID NO: 44807 - DNA, 443 bp, Homo sapiens
tttatattagatggggaattttcacatgtaaaccttccctaggtaagaaaaagaaaaggaagattcccgaaagactcagatagaagagagagggtaaccgtcaaagaaaacacatcctgtctaggataatatggggtctggatcatcaaaattgtctgaatttttattgctttccctgccattatgatttgaaaaggcttgttgagatgtcctctctaccagattggataaatcaatgtccttggctggaatgttcaagctcagagaggccaggaactcaggtgtgtgaccttcgactttttaataaatagaaagcaatgaagactgcctgaggttacagatcattgagatgagttttaattacccttttggggagacacaagccaaagcgttcaacaaaactacaacccattggttctctcgagtttagaacattaatgtct

SEQ ID NO: 44808 - DNA, 389 bp, Homo sapiens
cctgataattgccaaacttctcttttgtgggaatagcctgtattagccctagatttgatgggaagtccagtcagaatgttatggggagaatgctacttcgccactcctcaagtttccttccaagtggatggtgccccattcttgtcatctcctggtcactctccctttttactccacccttgcgcaatgtgggagatgggcaagttggagagaggagtcatttatctgattgggaaatttagaaattggtcatatgctttctcagctttacccagtttttccctcttgggagtaagttatcctcagatagagctcccctctactctatgctctcactcctaagctgagcaagttccctgtccatcgactgtatctgtggtaggtaagtc

SEQ ID NO: 44809 - DNA, 2750 bp, Homo sapiens
  misc_feature (2439)..(2439): n is a, c, g, or t
aggttatgtttaagacaattataaatggggtggggaggggacgggcaagagagttttctacatttcactctaactggtaaaatgtagatatcaacagatctttatatagcagtgaagcagttccatatctcaaatgtgttggtaggaagataaaatggcataaaatgatatacattgtgcaaatatcaatttcctgtagttacgtaaagatgtatctgtactgtcttttcaactccctgtaagtctgtaactattgcgaaatcaaaagctttaaaaagtataggatgaaagtattgaatatgctgctttaaaagggacagggtacagttttattggcttagagaaaaaaagcgggggcagggatgaggtgacagtcctcctcacctgaataattgcagctgaggattaaacatatctcttcccaaatactttatcttctaggtatacttctcttacaatttattagaaagctggttacttgagataactaaagagatactaattttcatgcaaacccatcacaatgtattgaaactgagatacttttctgctgctaacatatttaggaaaaatagttttatttttagtaaataaaatctccacttatttcaataaaaatggcaaggagaaaatgtcataagattatcctgccatgtaaaataagctgctccccaaaggactgtgtcaagattggttttaaatagaaaatatctattttaaatatatttagattataattgcctgggggttggcaaactttttctgtaaagggccagatactaaataccttaggctgtacgggccttcagatctctgtcacaactgttcacccgcgcggtgtagtgtgaaggcatccacagacaaaatgtaaacacacaggtgtggctgttctaataaaacctcaccaaacaggcagcacaggccacagtatgctgacctctgcactagcctcatctcaggttaactgtcctctagttattaaaaaagaaacccaaaattaagttacacaaaagtaatttttaaaaactactttggacgttaaaatggggccaaaggtagaatccacggaggtaaaagttcttgacgagcagtcaggaaatctgaatgattctgtcctttgttctgcccataaccagctgtgagctcttgggcaaatcacatattccctctgcgattccattattgcatctctaatctgaaaaagtagaggagggattccatccaattttgttactataaatttcagttcaagcaaacttactcccactgttaccaacaaaagtttcaaaagactcatttaaataatttataacatagttctggttaggcatgatgagctaaaaatgagagttggggtattaaaagcaaacaaaaaaagctgaaatatgaagactatccaaaaaacaacagcatcaaaaaccatgaaatacacagggatacagttaaaggatatataggatctctgcactgaaaaatgtaaaacactgctgagaaaaaatgaagtaaatggaaaaacatgtttatggattggatgactacttgacttatagattcagtgaatcctaataaaaatccacaaggcttcttctgggagtagtttggtggaaattgacaaaatttatttggaaatgcaaaggacctagaataaacaaagcagtttgcagaagaagaaattagaacgtctgttttacctgagatcaagacttaccaagttttgacaaaaagataaacagaatggaacaaaactagagccacagatatatggtcaaatgattttagaccgggcaccaaaacagtttaacagtgaaaggagactctttgacaagtggtgctggaaccactgaacgttcagtagaatgttcaaaggtatttgatgcctacctactttatggcatataaaaatactaattcaaggtgaatcacagacctgaatattcgctacaactatcatactcctaagaaaaataagagtatcttcatgagcttgggtaggcaaagacttcttaaagagcacaaagaaagcattaactataaaacaaaaattcataaattggatttcaccaaaactaaacccttcttctcatcaacagatactactgagaacaggcaagctatagagtgggaaaagatatgtgacacataaatctgacaatcctttatgtccagaatgcacaaaggagtcctatccaattaaaaggaaaaaaggacatgaaaagtactgtccattagtcatcagggaaatgcaaactaaaccaccatgagataccgccacatatccagaagcatggctaaaatgcaacaggtggacaataccaattgtcggcaaggatgtaaaaaacaaccagagtacaatgtgctggcaggaacacaaaacagcacaatggttttagaaaactgttgggcagtttcttaaaaagttaaatatacagctaccataanacctagcaattctactcctagctttttaatccaagagaaatgaaaacatgtccacaaaaatccctgtacaagaatatttatagcacatttataatagccccacagaaacagctcaggggtccatgaacagaaggatagctacataaactgtcatgcattcaaatagcacgacacaacaataaaaaggaacaaaccaggctgggcatggtggctcacgcctgtaatcccaacactttgggaggctgaggtgggtggatcacttgaggtcaggagttcgagaccagcttgaccaacatggtgcaaccccatgt

SEQ ID NO: 44810 - DNA, 1818 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggtctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaaggtgtctttcttggatataat

SEQ ID NO: 44811 - DNA, 581 bp, Homo sapiens
gcacagggaaatgaaatactagagtctgcctggggagcagcagggccaggccgagcatgtctaggagtccatgtgtcccagtggggtggctctcgtgggacctttctggcctagtttattctaaatccgttacttcccaacctgtgttctgcagaacgtggtacagtggggtggtcaaaggctatcttcaaaggggctctgtggctgatgaattggggaaatgccacaaaaagcagggctcgtagtgcgcgggccagcaccacatggcacttcacgttctcattcatccctgggccccccgctctgtggtgccccttagcatcccgcagagcgcttggggagtccctgctcaaaaagtgtgggtcccgcacccccaccttcactttagcagacatctgctaatgaaaggattaactgcttttcttttttttaaattcagacaaattcaaaaagagccgtaacactgggattagcttcttgagagcaggaaccacattcattctttgtgtctgccctgtgactatccagggagtagttggacttcctcataataaagaatgttctgatagccaaaaaaaaaa

SEQ ID NO: 44812 - DNA, 2399 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggtctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaaggtgtctttcttggatataat

SEQ ID NO: 44813 - DNA, 2481 bp, Homo sapiens
aataggtctaggtggaggctggtgttaatcggacgaggggagtccgcgtcgtcatgcatgtccccggcggtgctcgtcactccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggcacgggacgcaaggcccggtggtttccacacttgcaggaattcccttggctggcttgttggttcttcccacagggaattggccccggaaggtttgcgccaaggggccaagccccccaagaaggctaggcttaaggaagtttcttagtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggtctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttccccctttcccaggaaaggccagcccagtccatggccttcttgggcctctgggcacagagccaatgttcgtcattgcagctctcagcaaactgggtcatagctttccccacagctcagcctggggcctgggcagggctcccagcctgcaccgcctcccactgccagtggggcatgattctctcaggcttctgccccgaggccttcgtcgtcctcagggtctggacttggtcagtggcctttcaccagtggagctgccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaaggtgtctttcttggatataat

SEQ ID NO: 44814 - DNA, 2140 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcagagttgaagaggacttggaccagattctgaacctgggagctgagcccaaacccaagccccagcttaagcccaagccaccagtggcagctaagccggtgatacccagaaaaccagctgttccccccaaagcgggcccggctgaagctgtggctgggcagcagaagccgcaggagcagatccaagccatggacgagatggacatcttgcagtacatccaggaccacgatacaccagcccaggccgcccccagcctcttctgacccttccatgctggcccctggcccagcaggcctgtctgtggggacatcggtgtgaagggaagggactgggccctgcagggtcagaacctccccacccccaggggaggccaggcagaagcctgggtcacagcacccagaactgcatggttccattttctccggggctgtggggccaaagtagaagcctgcgggctgcgggagcggctctcaccctaggagccagagcccaatgtgtcttattccccgtggacatgaaggggagggagggtgtggggatgccttgccaaccagaagcccagccccaaggatgaagcaagacatgtggggccgtagcgaggtgtcacatggggcagggaagcttcatgcccacgggttctgccagccccagcacagacccaaactggggctgggcctctatccctcctctgcctctgttcgcatagtaagaaggagtgaccggtatcctccccttcccctaccctaagctgtagcctgggtgactgactggcctgggcctggggtggggacgtccccaagccaaattactccagggtctctgctcctcgtggctgccaggggcctgcagggtctgggtgggtctcccaggagaggaatactgagtgggagatcggctgtctggagtgttctgatgcaagtctctctctcctgagcctcctcttgatgcaagctctaaagggagaagtcaggccctgcctctccagggtatagacggccctgctaggccccagttcttcctccttcccagggagaaggagccgtgcgccagggcagggcccgtgccttagacttctcccgacccccagagcgctggtacacaggtctaggcaccacacagtgctttggaaattctcagtgaatgatgtttaataaagcaaaaaatgtcaaggtgtctttcttggatataat

SEQ ID NO: 44815 - DNA, 1273 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcaggtaccacctgtccccagcggcgcttggccagctctgagagtgttctggacagagccaagggcccggctcattgcccagtctcagccccagcctcctctgaggggaggaccccaggcctgtgaaaagtagaagcctgtgggtgcacattgggtgagaggcggtgaagggggctgagggggaggatccgcagcccagggctgctcagctagttccagaaagagagaactttgtgtgcacaaccagtctttcttttcacaatcatattttaacagtttatgtaaagaataattaaattatataattgcaagagcaggtataa

SEQ ID NO: 44816 - DNA, 459 bp, Homo sapiens
gggcaggccagggcagcgggaggcagggcggggacgcggtgacgcgggcactgccgggtcccgtgactgcgcgccccgcccggagtccccgccgccgtcatgcagtccccggcggtgctcgtcacctccaggtgagccagacccccgcgccccacaccgcacagctcgcagtccggggcgcccgggcggagaggcggggggaggccgccgcctcctaggccagggacctggtgcaggtctccccagcgccctcggtggcttatccgggctgggcccctgcaccgccctgcaggagaggtggcgaccccgatttacagatgaggaaaccgaggccctctggagggtagagaactagccaaggacagcgggagccctgggactgactggttcagtgcaggcgggcgcagtggggactctgctctcctttcctaccgccttgggttcttctcttttgagccc

SEQ ID NO: 44817 - DNA, 809 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcggttggtctcctgttgttgagagggcccctttggtgtattccaggctttctggagatgacgtcccccttccctggaatctgagaaaagccctgagcatcccaggtcgccccctcgcagggatctgggccacgaggccttggcctggtgtgttg

SEQ ID NO: 44818 - DNA, 1096 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcagacaaattcaaaaagagccgtaacactgggattagcttcttgagagcaggaaccacattcattctttgtgtctgccctgtgactatccagggagtagttggacttcctcataataaagaatgttctgatagccaaaaaaaaaa

SEQ ID NO: 44819 - DNA, 1205 bp, Homo sapiens
actgcgcgccccgcccggagtccccgccgccgtcatgcagtccccggcggtgctcgtcacctccaggcgacttcagaatgcccacactggcctcgacctgactgtgccccagcaccaggaggtacggggcaagatgatgtctggacacgtggagtaccagatcctggtggtgacccgtctggctgcgttcaagtcggccaagcacaggcccgaggatgtcgtccagttcttggtctccaaaaagtacagcgagattgaggagttttaccagaaactgagcagtcgttatgcagcagccagcctccccccactacccaggaaggtcctgtttgttggggagtctgacatccgggagaggagagccgtgttcaatgagatcctgcgctgtgtctccaaggatgccgagttggcaggcagcccagagctgctagagttcttaggtaccagatccccaggggctgcagggctcaccagcagagattcctctgtcctggatggcacagacagtcagacagggaatgatgaagaggctttcgacttttttgaggagcaagaccaagtggcagaagagggtccgcccgtccagagcctgaagggcgaggatgctgaggaatccttggaggaggaggaggcgctggaccctctgggcattatgcgctccaagaagcccaagaaacatcccaaagtggccgtgaaagccaagccctcgccccggctcaccatctttgacgaggaggtggaccctgatgaggggctctttggcccgggcaggaagctgtctccacaggacccctcggaggacgtgtcatccatggaccccctgaagctatttgatgatcctgacctcggcggggccatccccctgggtgactccctcctgctgccggccgcctgtgagagtggagggcccacacccagcctcagccacagggacgcctccaaggaactgttcaggtgggaccatctagttgcaggcaaacaagctcagggctcccactgattctacattatggtgtttctgtaagagacacacagtggagaagagaaggccacgtgaaggctgaggcagggatgggcgtggtgctgccaccagcgggggaacgccaggaactggaagaggcaaagaaggaccctctgagggcgcagggtcctgctgacacctcaacttcagacttctggcctccagggctgtgagaggagacttt

SEQ ID NO: 44820 - DNA, 412 bp, Homo sapiens
tttttacttcatgtttacctgttagccttatctgcgcacctgaacttcagagagggtctctctctgttcttttgctacttctctagtagtcgaatgctcttacttaggtgttacttggagctagtttgtgttgttgtggtgggcatggggccttggatgctgtttagctttgtggtggtaggaattgagctttctcttttgttctagaccagtattagtcttaggcaggctctgttttcctctattcttgataatcctccttctccccagtagtaggagacctctattgttttggtcttaggttactttcttgtctgtccttcagaagtacatacagtatcatctaattttgcaggaatttattaggaagtgttttcacatcctgtattaaaaggaatatatttggaagcca

SEQ ID NO: 44821 - DNA, 1007 bp, Homo sapiens
agcagcaggctctgctgagtgacattttgcaaggctgaggcccccgtaggcgcaggcgccgttggggtgcgcatccggggacctgcaggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagtttttcagacttgttttacattccttggagaaaaaggtgtgacatgggatgtgattaaactgcagataaacatgtatacaacaccagttttacttagcgccttcctgggaattttaaatattattctgatccttgccatactaagagaacatcgtgtggatgactcaggaagacagtgtgaaaagtataaatttcgaaagaagcaagtaccagatgaagctcaggttccccaagggaata

SEQ ID NO: 44822 - DNA, 1293 bp, Homo sapiens
agcagcaggctctgctgagtgacattttgcaaggctgaggcccccgtaggcgcaggcgccgttggggtgcgcatccggggacctgcaggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggtaaggttgtatgtatatgtttggttgtgtcatattcacattcattctgacatttatggctcacttttaactggtctcatccccttttaaactcatatttcacagttcaacatacatgtttctcattgtaaacaaatatttttcttatcattttgcctttgctcatgatgttctcattacctatagtttctcttctgttctcatcattcttcatccttcaagattcagtttaaaccaggtgtggtggcacgtgcctataataccagctactcgggagactgaggtagcagaatctcttgagcccaggagttcgaggccagcctgggtaacatagggagacctccatctaaaaaaaaacatcactgggcgcggtttacaacgtcgtgactggggaaacccgggggtaccaaattaacggctggggagaatcccccttggcagagggggaaaggaaaggcggccaagtgcccccccaaagggcccccagagaagagacagagggaccatgtcaggcccccccctaggggccccctaacaccacacgggggcgccccctccaaaaccccgcgctcgcgcccagacaccaccccccagggccacccgcggccgccaccccaccggggcgcgcccaccccccgcg

SEQ ID NO: 44823 - DNA, 870 bp, Homo sapiens
agcagcaggctctgctgagtgacattttgcaaggctgaggcccccgtaggcgcaggcgccgttggggtgcgcatccggggacctgcaggttacaagcagcagatcccaccttcagtcctggctctgacaagccctccagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagtttttcagacttgttttacattccttggagaaaaaggtgtgacatgggatgtgattaaactgcagataaacatgtatacaacaccagttttacttagcgccttcctgggaattttaaatattattctgatccttgccatactaagagaacatcgtgtggatgactcaggaagacagtgtgaaaagtataaatttcgaaagaagcaagtaccagatgaagctcaggttccccaagggaata

SEQ ID NO: 44824 - DNA, 309 bp, Homo sapiens
gtaattagatagaaatgataaaactatttttgtagattgtgaaatttaatgagctttgtaattgttggaagataattatccttatgaagtgtacgtagttttttatgtctatagtttgtttatattttttggtcaggtagtactaaagcatgtaatactggcaaccaaaagacaacctgataaatgagaacagaaaaggaaggtctttgaagattcaaagttttttttttttttttttttttttttggaaacaaaaatttactttggggctcaaactggagggcaggggcacttttttgggtaaatgca

SEQ ID NO: 44825 - DNA, 833 bp, Homo sapiens
agcagcaggctctgctgagtgacattttgcaaggctgaggcccccgtaggcgcaggcgccgttggggtgcgcatccggggacctgcaggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggaaatgtagcagttgttagatcatatactgctggtgctacttcccttcaggaaagaacaagttccatggcaaacataagcatgtgtcaagcattaggttttattctaggtccagcaagtacagatgaagctcaggttccccaaggaaatattgaccaggttgctgttgtggccatcaatg

SEQ ID NO: 44826 - DNA, 1033 bp, Homo sapiens
agcagcaggctctgctgagtgacattttgcaaggctgaggcccccgtaggcgcaggcgccgttggggtgcgcatccggggacctgcaggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagcattataagagccgatggagatctattaggattttatatcttactatgtttctcagcagtgtagggttttctgtagtgatgatgtccatatggccatatctccaaaagattgatccgacagctgatacaagttttttgggctgggttattgcttcatatagtcttggccaaatggtagcttcacctatatttggtttatggtctaattatagaccaagaaaagagcctcttattgtctccatcttgatttccgtggcagccaactgcctctatgcatatctccacatcccagcttctcataataaatactacatgctggttgctcgtggattgttgggaattggagcaggtaaggttgtatgtatatgtttggttgtgtcatattcacattcattctgacatttatggctcacttttaactggtctcatccccttttaaactcatatttcacagttcaacatacatgtttctcattgtaaacaaatatttttcttatcattttgcctttgctcatgatgttctcattacctatagtttctcttctgttctcatcattcttcatccttcaagattcagtttaaaccaggtgtggtggcacgtgcctataataccagctactcgggagactgaggtagcagaatctcttgagcccaggagcagaggttgcagtgagctgagatcacatcattgcactccagcttgggcaacaagcgcgagactctgtctca

SEQ ID NO: 44827 - DNA, 976 bp, Homo sapiens
tgaggcagagcctcgctctgctggttaggctagagtacagtggtgcgatctcggctcactgcactccagtctgggtgacagagactctatctcaaaaaaaaaaacctatatatatagatagatagatagagatatatataaatatatatatatatagagagagagatatagtttaactgaaattcaaacttaagtgggcaccctgtatttttatttattaaatctggcaacttgattctactcctcactcccagatctcccctctctgtgtggggcccataaggaggcacatcatcactatccttgataagtgactctaccctggcttcccacccccacctcccagcaggtcaggaaagcacctatgtcactatcatttaggggcttgtcaaacatgcagtctcagagactcccctccagacctgcaaaatcgtaatctctaagaaagagatttgagaatctgtttaataagtacgaaaagatctttaaacacccttggcttacaactgcttctctagggaattataatctgagagtggcaacagtgactcagatatgaagaccaacgacgttaaccgaatgtggaagtgataactagagtgcagcaccatttgtagggcttgagaagcaggcatcagtaaggctcgactaaatgctattctttctagtgattgaggatgctttaaaagtggttacataatgaggtgggctcagggggttgtatagatatgctttttcacacatgtagttccctagaggaatggaagggatagagaggaagacaagtaatcactggagcaaggcacaggggtgcccagggcaaaggacttaaggacattaacaatcatcttcaggccaggtgcagtggctcatgcctgtaatcacagcactttgggaggccaagatggaaggatcgcttgagcccaggagttcaagaccagcccaggcaacctagcaagactctatcgcaattaaa

SEQ ID NO: 44828 - DNA, 295 bp, Homo sapiens
ttgtatgtaagtgtagatgagggtgtctgtgccttgtgtttgtatatgtgagtatccacatgagcatgcctatgtgtatgagtgtgtatgtgagtgtggtgagttgcttctgtccacacatttgtgtatatgagtgtgcatgcaagtgtgctgagtgtgaaagtgtgcctgtagacatgtttgcctgtgtgtgcgtgtgtcaaacacagctgtttctgtgtgtgagtgtgccttatctgtgtgtgtgcacgtgtgtgtgcacgtgtgcacgtgaatgtgttgagtgttcctgtgt

SEQ ID NO: 44829 - DNA, 465 bp, Homo sapiens
caggagatcgagaccatcctggctaacatggtgaaacccggtctgtactaaaaaaacaaaaaacaaaaaacaaaaaacgaaaaacattagctgggcgtggtggcatgcgcctgtactcccagctactcgggaggctgaggcaggagaatcgcttgaacctgggaggcagaggttgtagtgagccgagattgcaccactgcactccagcctgggcaacagagcaagactgtctcaaaaacaaaacaaaacaaaacaaaaaagcaaacaaaactaactcccccaaaaaccaaagacttccggataaattgtgggaaaagcatatgtgaatggttttcacatatgtaggtactgtagggcactgggaagggtggccacataggaagaagtctctgttctcagggatcctctattcctttccgcagaggctcaggatggcaatggggaggtgtggggaggggtgagaga

SEQ ID NO: 44830 - DNA, 926 bp, Homo sapiens
ccaacagaagagaacacaaactaagaccaagggaagccatgttcctagcaccgtgccatccctgctcccagctgaggcttggaggaggcctaccctgctgatcacacggagaagagccaggactccgaggtcacccgcacacagcgggatggcatctccgacactcccgtggggaagcagcgtcactgtgccctgaagactcatgtttgagataggcaggcagcgctgctccatcagccggctggacagttttacatctcagggaagggcactgtgtcatggatgtaaatggcatggcacagcaatatctgtggtgtctagtggtgatgaagtccaggtgctgttagtggaggaaatgctaaattgcagttagacattaatgaaaatagagatgcaatgctttttcattgtgatgcatgggaccccaaattctccctagacctctggacccagcataaggctcctgtgcctgctggccaggctagggtgtggggaccttaccacggcacgtttccttggtgaggccatgtcaacattcctcgtttctcacacttaggacccctcccacgagtggggggtatgcagccctccaaggagccagtggtctcagacctgccaccccacagccagaggtttctggccccaggccactggtgttttccctgccagtgcaggtgaattctggaaggagggtgcctgggaggtgggtgtgggggtggtgggtgacttcaagcctccaaagaccagagggaagggtctgcctcatggagctccgtgagcaaaggccaggaggcacccaggaccccgagtccgtgccagctggcatcggggggacttggagatcagcctccccggggccgccacctccagggccctgcagagaacagggctatcctgagcatgccagggtcctgggaatgtccccc

SEQ ID NO: 44831 - DNA, 346 bp, Homo sapiens
tctgaggatattagaaaactgaattaaggtccattttgtcttactgaattttaaaggttcaaattctaaagttatactattgattataatgttaattttaataaaagtgtcccttttaaataacggaatagtgtttgtgtgtgtgtatctgtgtgtgtgtgtgtgtttttgtttttaagagacagggtttcactctgttattccggatgtagtgcagtggtgcagtagtcatagctcactgtaaccctgaactccaaggctcacctgagcccaggagtttgagactgcagtgagctatgatcatggccctgcgttccagtctggatgacagagtgagaccctgtgt

SEQ ID NO: 44832 - DNA, 979 bp, Homo sapiens
ccggcctaaatgtactcttcatatttccatcatatgtttcaaattgtgaaagtggttagagtgcgactgttattgttcttgttgttgttgttggtatttttctcagtgcctaaataagactgtgctaattattttcttacatagaaattctcctcactttctagtgaaactatcagactaattgcagatcttttattactagatggttattttgatctgctttagcctttatgctaaagtttgcatcttttcatattaattctgagtccttgttatctagttttagtgacatttataaacaacactgattcctcaaatcacatttgagcacacttaaggcagagttacttctactaaccatcctgtaagaccattttgtttaagcgtcaagtgtcaccaattactaactaataggccataacctctctgactcagggattgaagttacgttccctagggcatgtcttccagaactttttctcttatacttctcttagtgctttctttactatgtaaaccaggggtatccaatcttttggcttccctgggccacattggaagaagcagaatcctcttgggccaaaaaatatacaaacgatagccgatgagctaaaaaaaaaaaaaaaaaaatcatgaaaaaattctcgtaatattttaagaaagcttatgaatttgtgctgggctgcattcaaagctgtcctgggctgcgtgtgtcccacaggccacaggttggaaggttgcaggttggacgagcttgataaatatatagttagaaaataccaaaggcatagtttctttagaaatcacatgtctcaaagtaaattatcttttcttggctttttacatttaaaaaatttcatgtattccctattttctataaactacaaaaaataaaaataaaaacaataataaaatttgagagttgaaagagttgggaagggtcgagtctcactccttcttttcaaagttgaggagatgg

SEQ ID NO: 44833 - DNA, 299 bp, Homo sapiens
acactgcagagcaactacatcaaaatctctgctcttgggacttaaacattagtctttttctaaagttctccaggtgatcccagtattcaggcaagcaagagaatcaccactttgtatggtactctctgtgctcccaagaaataaatatatagacaggaagggaatggatttcatttgctgaatatatttgaatccaagagtttattacttttctttcctcaatgcagtataatcaatatttaaatacacatgcagagtgagagccagataaattaaatcaaacaaaatatcataaattg

SEQ ID NO: 44834 - DNA, 2661 bp, Homo sapiens
tttttcgagatggagtctcactctgtcgtccaggctggagtgcagtggcatgatctcagctcactgcaacctctgccttctgggttcaaacaattttcctgcctcagcctcctgagtagctgggattacagccacctgccaccataccaggctaaattttgcatttttagtagagatggggtttcaccatgttggccaggctggttttgaattgacctcatgatctgcctgcctaggtctcccaaagtgctgggattacaggtgtgagccactgcacccggcccagctcttctttatacaataatggaaatgctaaaatgaatgactcttcctgctcacttaaacctgtgctcaaaatgacatatttgtcaggcaccctcttcatttaccttaaagaaggagagtttaatgtccatcttggttctgccctatgaatcatcttgtcaagaacaggtgttcttatgcagaaacaatgaaaaccttatactgaagtgtgaaccctggatttcttagtttcttctgagtcctagaagaagggttggaatagaataatacatttacaggatttaggttggttttctttctgtccagtctcatctgaatttcgtctgtctcttgtggtccagaagttccacagagcaacgcagctgcatgtggtgacaggtagagcagttaaagctgccaataggaactcgtccatattccacacacctggtatagtgttatgccctccatgggcacttacctgcaataagcagaagccactgccacattcccgtgtattgggaaaatggactactgtgtgcgaacaggccctttaccctaatggcagggaagatggattatctttggccagtggagctgccaatctagacatacacattcaactgaatacaattaaaagcagttctttaaatgcaaatataattactcatctttataatacaatagtattaactgcccatatgctcatagtatgatgagccctgtatagcacaaggtcaacaggtcctctccttgtccttacaatctaaagcagatgacactgacatggacaaacaagtgcacatgcatagttgcggcagttttagagaaatctagaaagctaggtagcaacactatgcataaatgttgtggtccaatgcattagtttgctttaacaaaaatctgggaggtattttttctctttattcaggaaggcttcatgaagcaggaagtggtcaaaggagggaaggttactggttaaattatgataggaagaactttccataactagttgcaaaattgagtgctgggtgggttgaggaatgggaaaaagggggagcaaggtgttttgtgtagatggaacaaagggcaaaggatagactgtaaggaaggccagataaagcttggagtagcatgagaacttgaggaatagtatgatatgggctgtgcagcaggcagagagaatcaccttagctgaaacatgggtgttaggagcagaccatgaggtggtagaaccatcatctatagtaaatcaggtactacgctataactattgataaggaaacagctgactgccactgaaagaataagcagttttaggggactagctcctatgggagataaaggtcagaaatcgtagtatctgatgaagatattttgatgagcaggtgagaagaaagataaacatggccagatggccaaggactgggataagtagccgtttcacattcaattagaattctgtggctggaataagatcagggagagcagtaggaagatatagtattctataattcatagcttgttgtgttagagattaattaggattctgctgttgaatcttagtacaaaaaaatctaatatttattaggaattaagggaagatggtacttctgttatgttgcctaagcagacaggaagctacaagaaacaccagtctgaagcagtgcctcaggatctcagatgatttaggaagtgtgctgtaatgtcaaaaaaaaaaaaagtattgtctttagtatatctatgtatagtctcgtgggaaaagcattggttgtggtatcaacagatattctggttccagatgtcttgtaagttaacctgcctccatttccctttctgtaaagcaaaataatgtttacacctaatctgtctctcagggataccatattaataaaaattatgtctataaacaacaaaaaaaaaaaataaaaaaaaaaaaaaaaaaaaacacaaaacaaaaacaaaaaaaaaaacaaacaaaacaaacaaaacaaacagaacaaaaaaaaacaccacactaaacaacaagacaccaataaaacaagctaaacacaatcactccatctccaaataccacagcaccacaacagacgatcatcatggagaaggtagaggaagacaggggagagaatgcagacgtggccgccagctggccgtaggtcgtgaaggcggatagcgccggactaggcgagatggcgcgctggcgtcgcgaatcaaggcgtccacgcactacggatgtgagagtgcgaataaaattgaggaagaagcagagagcgacagcgactagtcgaatcaaggtagacgagagcagaactagaagggaggaagaagggctacggtcagaaggacagacgacgaggcgggaggataagagcagaaatagcaacgtaggctgat

SEQ ID NO: 44835 - DNA, 394 bp, Homo sapiens
gactcaggagccctttccttccagagcatctcacagggctagagggctccaaaaacactgagccaatgaaggtgggaaacaagcactgagggtgcaggaccatcgcagacagagtttgggaaaacttaagaggaggatgaggcctggtgcagtggctcacacctgtaatcccagcactttgggaagccgaggcgggtggatcacgaggtcagaagttcgagaccagcatggccaacatggtgaaatcccatctctactaaaaatacaaaaattagctggacgtggtggtgggtgcctgtaatcccagctactcaggaggctgaggcaggagaatcgcttgaatccgggaggtggaggttgcagtgagccaagattgcacaactgcactccagcc

SEQ ID NO: 44836 - DNA, 561 bp, Homo sapiens
aaaaaaaatacaaaattagccgggcgtggtggcacatgcctgtagtcccagctactcggcaggctgaggcaggagaatcgcttgaacctgggaggcagaggttgtggtgagttgggcgagccattgcactccagcctgggcaacaagagcaaaactccatctgggcaacagagcgagattccgtctaaaaaaaaaaaaaaagaatgttgtgataaaaggtgatgctcacctctcccacacccttttatagtttagggattgtatttccaaggtttctagactgagagcccttttcatctttgctcattgacactctgtacccattaatcctccttattagctccccttcaatggacacatgggtagtcagggtgcaggtctcagaactgtccttcaggttccaggtgatcaaccaagtgccttgtctgtagtgtcaactcattgctgccccttcctagtaatccccataatttagctctccatttcatagtctttccttgggtgtgttaaaagtgaccatggtacactcagcacggatgaaatgaaacagtgtttagaaac

SEQ ID NO: 44837 - DNA, 282 bp, Homo sapiens
gatcacttgagctcaggagttccagaccattccaaagcaaaaacaaaaggattttgagatcagtgtgggcaacttagcaaaacaccatctcttaaaaaaaaaaaaaaattagccaagcttggtggtgtaagcctgtagtcccagctacttgagaggctgaggtgggaggattgtttgaacccaggaggttgaggctacagtgagctgtgattgtgccactgcactccaggttgggtaatgcagcgagactgtgtctcaaaaaataaataaaataaaaaataa

SEQ ID NO: 44838 - DNA, 659 bp, Homo sapiens
cagactggttgcaaactcctgacctcaggtggtccacccacctcagcctcccaaagtgctgggattacaggcataagccactgcatccggcctcatctgtaaatattttggtatgtacttcagtaaaatattttttctgtaaacataactaccatatgaatttctatgtaaaaataaaaggaccagcctgggcaacatggtgaaaccctgtctgagcgaataaatgaatgaatgaacaagaaagaaaagcaagcaagctgggtgtggtggtgtgcacctgtagtcccagctagttgggaggctgaggttgcaggatcacctgtgctcaagaagatggaggctgcagtgagccataatcatgccactgcaccccagcctgggtgacagagtgagaccctatctcaaaaaaaaaaaatttttttttaaatgcttaatgatctcattattatcaaatatctaagcagtaatcaaatggatctgaatattataggtttttttaaacaatggtttgtttctataaggatccaacaaggcctacacagtacatttggttgatttgtctcaaacctaattaatctcaagttacccctttgcttcacttgctttccttttcttcctatttaatgtttttgtggcataaactgagttgcatattcaat

SEQ ID NO: 44839 - DNA, 352 bp, Homo sapiens
gtggggagcaagccatgcagctatcttagggaattatattgtaggcagagggaatattgcctcattggagtctttgttctttttaaatctcacagtgtgtcttctgccatgttctcaaatttttatgtttcttgtggtatttgttttctgtcctgtgtgatctaagtggtctcattattttcctcactaatttgggcagcaaacatttttgggtgccagtgtcctagatagatcccatcaataaagccaatcatttttctctaatatgtttcaaatcaatttcctcttttatctccactactttttaacccgatctccatccagacgtctttttattttagtcatccactgc

SEQ ID NO: 44840 - DNA, 438 bp, Homo sapiens
gcactagaagtaactttgttgagtctaaatctaacacatactaaagacttttgattgtttgagaaaaggcttggtccatagggatttttatttgtttaaaaatatttaataaaggccgggtgtgatagctcatgcctgtaataccagcactttgggaggccgaggcgggtggatcacctcccaaagtgctgggattgcaggcatgagccactgtgcctggccaataagggtttaatagcaatgtaagcaaacccccaatttatctttggcttcctataaatcatgtggctacgaagaggcctcaggaactccactttctttgctattaccagtcatttgtaatttcctttctcacctttcttttgaattttcttgtggagctgatggaaacccatttctacttttctacctcgttatctatctcacccccaaaaataa

SEQ ID NO: 44841 - DNA, 3487 bp, Homo sapiens
  misc_feature (1544)..(1544): n is a, c, g, or t
  misc_feature (1610)..(1610): n is a, c, g, or t
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaaggtgggccacgcccctggcctgccccacgactcgggtgatttcccacctcctgcgggtccctggccctgccgggtaactcccgagatcctatcctggtctcccctttgactccgccctctccctcactcccccaggcccccagcattccggacactcgcctccccagtcgcaaggtatcccagatctccttgcaggtggcgatgttacgggcactgctccaagaggctcgatcctctcaagcccccagctcccggtctccgccacaaagccatctgtgagggcaggtgggagcctcaggcctgggccctttccctagataccaggtgggctagcgctgcccctaacaaggagccagggttgccttttctgtggtttccagaaaggagcctctcagcttccttcctgtgcaccttctgcagggaccaggcccaagcttgggtccagtatagccccagggtcctgcactttgccttggaggagcccaggtgtgatttgccagaacaggagatattccagatgagaggtggtgggcccagagcggtcacagagatctcagcatcatcaaggaccaactgaacgtgtccaacattgaccaggtggccagacacctgaggtgaggcccaggggcacctgcatgtgtataggcaggggtggagacaaggatggatcttgaggtgctgggattgtgagacaggaggtgggtagtatacttggcggggaggcccatgtgcgtaaggctgagaggtggaaagagctggctgctatagagctagtgaggttgctttcaggaagcagccaagtacagatgccacggccgagcatgatggtgcatgcctgtaatcccagcaatttgggaggccgaggcaagagggtcatttgggcccaggaattcgaaaccagcttggccaacatgggaaaaccccatctctaccaaaacaaatacaaaaattagctgggcgtggtggtgcacgcctgtaccagttacttgggaggctgaggtgagaagggattgattgagccctggaaggtaaggctacagtgagtcatgatgggtggcagagcaagaccctgtttctttctttctttctttctttctttttttttttttgagatggagtcttgttctggcgcccaggctggagtgcagtggcgtgatcttggctcactgcaagctccacctcccgggttcacaccattctcctgcctaagcctcccgagtagctgggactacngatgcccaccaccatgcccagctaatttttttgtatttttagtagaggcggggtttcactgtgttngccaggatggtctcgatctcttgatctcatgatccgcccatctcagcctcccaaagtgctgggattacaggcatgagccacctcgcctggccgaccctgtttcaaaaataaataccttgacacaggggtagcctgtgtcagaggattttaagcagcggaagggctgtgatgtgggggaagatggaggcaagaagaatcacagtgcagaagtgtgggagagagaaggatgcctgccagggtgaggcaggcgaggggaagatacttcctgcccagaaagagcctcacaggggccagacgtctatgctgggtcagcccccaagcagcagagggcagtgtgggctgaggaaggacaggttgggtggggctcctgctgaggctggaggttggggccatgtggtggactcagctgagccctggtcctgtgtctcgggttctggctgctgctccctcatgtcccaggggccttctggaggaggagtgtcacaccttggagagggagatcctcatcctgcaggtgagccgcagccctgggccctcccccgagcctcactgctgagcgtagactctcacctgggtgagacccatgtacctgtgtgcatacataggtgcatgtacaggctatgtgagtcctgcatccatttctcaggggtgcatgcttgtgtgcacctgcaaaatcctggaggcccaggattctagttgagcccttaaggccagggccaaccgttttaggtcttttgcctccttcctttacctaagtctgggtacaggccccaccactatcttgccaaactcagctcttccgcaaggctggtattccctggggaacgtggctgccctcacggtggatgggctgaaggggctgcacgggcctgccctggggatcttggcctctgtatcctgccttgccccacccctgccttgagtctgggcactgacgcagctctccctgcagcgctgcctggaagaggagtatttgaggccttgccacccctctgaggcagccctggagcccaccctggcaggtgaggacacggagcagggcccagaacacccagcctcctgctcccaccccacacttgtacacaccctagaagagctgggcactgtctcagcccaatctctccttcagagctaaaggaacagaagaaggccatggagcaggagctgcaggcatctgtggggccttcttgtgtctctcccaaccacaggtaaaccacaacagtagacacagggcagggtggactgaaggatcagaccaccacccctcacagttactctttcttgtccaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44842 - DNA, 1717 bp, Homo sapiens
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaaggtgggccacgcccctggcctgccccacgactcgggtgatttcccacctcctgcgggtccctggccctgccgggtaactcccgagatcctatcctggtctcccctttgactccgccctctccctcactcccccaggcccccagcattccggacactcgcctccccagtcgcaaggtatcccagatctccttgcaggtggcgatgttacgggcactgctccaagaggctcgatcctctcaagcccccagctcccggtctccgccacaaagccatctgtgagggcaggtgggagcctcaggcctgggccctttccctagataccaggtgggctagcgctgcccctaacaaggagccagggttgccttttctgtggtttccagaaaggagcctctcagcttccttcctgtgcaccttctgcagggaccaggcccaagcttgggtccagtatagccccagggtcctgcactttgccttggaggagcccaggtgtgatttgccagaacaggagatattccagatgagaggtggtgggcccagagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44843 - DNA, 2569 bp, Homo sapiens
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaaggtgggccacgcccctggcctgccccacgactcgggtgatttcccacctcctgcgggtccctggccctgccgggtaactcccgagatcctatcctggtctcccctttgactccgccctctccctcactcccccaggcccccagcattccggacactcgcctccccagtcgcaaggtatcccagatctccttgcaggtggcgatgttacgggcactgctccaagaggctcgatcctctcaagcccccagctcccggtctccgccacaaagccatctgtgagggcaggtgggagcctcaggcctgggccctttccctagataccaggtgggctagcgctgcccctaacaaggagccagggttgccttttctgtggtttccagaaaggagcctctcagcttccttcctgtgcaccttctgcagggaccaggcccaagcttgggtccagtatagccccagggtcctgcactttgccttggaggagcccaggtgtgatttgccagaacaggagatattccagatgagaggtggtgggcccagagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggactttaaatcctagtggtgcacaatgggcagggatgggcggcgcaccgttattgctacagaggattagaggtggcttggccggggctgtcactgcacagaggacggacaaatgaacacttcagggattcagacacttcagaaggggctcccactccagagaggggaggggcatgtgggctggggccatttggcacatgaacgagggcagcacatttgggaagactgggcctttagcctcatggagggagggcaagggggtgtcgtgcagggtccccttccccagggtgctgggctcaaacctcctgtggagcagcccccaccccatcccccagaaacaaatgctttgggcaggctgctgggtcacgggcccctgctggctgggcctgacagccaggcctggaatgaggggcagagaccccggagcagcccagtgaggtgcaagcaggcctggaagacagactgaacccgaggctgggggcgaggaggtggcgaccacagagaatacaatgtttacaaaaataattacacagataaacagggctgggcagcacagcctgacaagtaacactgggcagtcccccagcccttcatcctgcccctagggaggaatagccaaatgtgcctggcagaggctggggtcggctctgagggcaggagcactagtcatggggctggaggcccacccagaacctcagctcagggcagggtataagggtatcggaggccacgtaaagccatccaggctgctggggacctggcccgagacccctccaaagtgctttggacctcccagcaaccctccactcccacccctccccccagctgctatcttggcatccaaaggacatgtaaacact

SEQ ID NO: 44844 - DNA, 1255 bp, Homo sapiens
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtgggaaacagttgcctagaagtgatatttgggtcctgaaggcctggggtgagcaacatgcggagagtgatagtgacttcattgccagcagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44845 - DNA, 2861 bp, Homo sapiens
  misc_feature (1544)..(1544): n is a, c, g, or t
  misc_feature (1610)..(1610): n is a, c, g, or t
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaaggtgggccacgcccctggcctgccccacgactcgggtgatttcccacctcctgcgggtccctggccctgccgggtaactcccgagatcctatcctggtctcccctttgactccgccctctccctcactcccccaggcccccagcattccggacactcgcctccccagtcgcaaggtatcccagatctccttgcaggtggcgatgttacgggcactgctccaagaggctcgatcctctcaagcccccagctcccggtctccgccacaaagccatctgtgagggcaggtgggagcctcaggcctgggccctttccctagataccaggtgggctagcgctgcccctaacaaggagccagggttgccttttctgtggtttccagaaaggagcctctcagcttccttcctgtgcaccttctgcagggaccaggcccaagcttgggtccagtatagccccagggtcctgcactttgccttggaggagcccaggtgtgatttgccagaacaggagatattccagatgagaggtggtgggcccagagcggtcacagagatctcagcatcatcaaggaccaactgaacgtgtccaacattgaccaggtggccagacacctgaggtgaggcccaggggcacctgcatgtgtataggcaggggtggagacaaggatggatcttgaggtgctgggattgtgagacaggaggtgggtagtatacttggcggggaggcccatgtgcgtaaggctgagaggtggaaagagctggctgctatagagctagtgaggttgctttcaggaagcagccaagtacagatgccacggccgagcatgatggtgcatgcctgtaatcccagcaatttgggaggccgaggcaagagggtcatttgggcccaggaattcgaaaccagcttggccaacatgggaaaaccccatctctaccaaaacaaatacaaaaattagctgggcgtggtggtgcacgcctgtaccagttacttgggaggctgaggtgagaagggattgattgagccctggaaggtaaggctacagtgagtcatgatgggtggcagagcaagaccctgtttctttctttctttctttctttctttttttttttttgagatggagtcttgttctggcgcccaggctggagtgcagtggcgtgatcttggctcactgcaagctccacctcccgggttcacaccattctcctgcctaagcctcccgagtagctgggactacngatgcccaccaccatgcccagctaatttttttgtatttttagtagaggcggggtttcactgtgttngccaggatggtctcgatctcttgatctcatgatccgcccatctcagcctcccaaagtgctgggattacaggcatgagccacctcgcctggccgaccctgtttcaaaaataaataccttgacacaggggtagcctgtgtcagaggattttaagcagcggaagggctgtgatgtgggggaagatggaggcaagaagaatcacagtgcagaagtgtgggagagagaaggatgcctgccagggtgaggcaggcgaggggaagatacttcctgcccagaaagagcctcacaggggccagacgtctatgctgggtcagcccccaagcagcagagggcagtgtgggctgaggaaggacaggttgggtggggctcctgctgaggctggaggttggggccatgtggtggactcagctgagccctggtcctgtgtctcgggttctggctgctgctccctcatgtcccaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44846 - DNA, 3299 bp, Homo sapiens
  misc_feature (1544)..(1544): n is a, c, g, or t
  misc_feature (1610)..(1610): n is a, c, g, or t
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggagagggaaggtgggccacgcccctggcctgccccacgactcgggtgatttcccacctcctgcgggtccctggccctgccgggtaactcccgagatcctatcctggtctcccctttgactccgccctctccctcactcccccaggcccccagcattccggacactcgcctccccagtcgcaaggtatcccagatctccttgcaggtggcgatgttacgggcactgctccaagaggctcgatcctctcaagcccccagctcccggtctccgccacaaagccatctgtgagggcaggtgggagcctcaggcctgggccctttccctagataccaggtgggctagcgctgcccctaacaaggagccagggttgccttttctgtggtttccagaaaggagcctctcagcttccttcctgtgcaccttctgcagggaccaggcccaagcttgggtccagtatagccccagggtcctgcactttgccttggaggagcccaggtgtgatttgccagaacaggagatattccagatgagaggtggtgggcccagagcggtcacagagatctcagcatcatcaaggaccaactgaacgtgtccaacattgaccaggtggccagacacctgaggtgaggcccaggggcacctgcatgtgtataggcaggggtggagacaaggatggatcttgaggtgctgggattgtgagacaggaggtgggtagtatacttggcggggaggcccatgtgcgtaaggctgagaggtggaaagagctggctgctatagagctagtgaggttgctttcaggaagcagccaagtacagatgccacggccgagcatgatggtgcatgcctgtaatcccagcaatttgggaggccgaggcaagagggtcatttgggcccaggaattcgaaaccagcttggccaacatgggaaaaccccatctctaccaaaacaaatacaaaaattagctgggcgtggtggtgcacgcctgtaccagttacttgggaggctgaggtgagaagggattgattgagccctggaaggtaaggctacagtgagtcatgatgggtggcagagcaagaccctgtttctttctttctttctttctttctttttttttttttgagatggagtcttgttctggcgcccaggctggagtgcagtggcgtgatcttggctcactgcaagctccacctcccgggttcacaccattctcctgcctaagcctcccgagtagctgggactacngatgcccaccaccatgcccagctaatttttttgtatttttagtagaggcggggtttcactgtgttngccaggatggtctcgatctcttgatctcatgatccgcccatctcagcctcccaaagtgctgggattacaggcatgagccacctcgcctggccgaccctgtttcaaaaataaataccttgacacaggggtagcctgtgtcagaggattttaagcagcggaagggctgtgatgtgggggaagatggaggcaagaagaatcacagtgcagaagtgtgggagagagaaggatgcctgccagggtgaggcaggcgaggggaagatacttcctgcccagaaagagcctcacaggggccagacgtctatgctgggtcagcccccaagcagcagagggcagtgtgggctgaggaaggacaggttgggtggggctcctgctgaggctggaggttggggccatgtggtggactcagctgagccctggtcctgtgtctcgggttctggctgctgctccctcatgtcccaggggccttctggaggaggagtgtcacaccttggagagggagatcctcatcctgcaggtgagccgcagccctgggccctcccccgagcctcactgctgagcgtagactctcacctgggtgagacccatgtacctgtgtgcatacataggtgcatgtacaggctatgtgagtcctgcatccatttctcaggggtgcatgcttgtgtgcacctgcaaaatcctggaggcccaggattctagttgagcccttaaggccagggccaaccgttttaggtcttttgcctccttcctttacctaagtctgggtacaggccccaccactatcttgccaaactcagctcttccgcaaggctggtattccctggggaacgtggctgccctcacggtggatgggctgaaggggctgcacgggcctgccctggggatcttggcctctgtatcctgccttgccccacccctgccttgagtctgggcactgacgcagctctccctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44847 - DNA, 1464 bp, Homo sapiens
gctagggccctggttcccactgcctggtttctgggcccccggcatccgagtcggccaaaagccgggcagaagagagcgccaaggactggcagttccggaacgggcaatcccagccgaggggaccagcggcagagcacgggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtggggtggcgatgttacgggcactgctccaagaggctcgatcctctcaagcccccagctcccgccccatctctgacccctcttctcttctggcaccaccgcctctcctaaaggacctcttgcgccaggagctccggcagttgctccagggtctccgccacaaagccatctgtgagggcagggaccaggcccaagcttgggtccagtatagccccagggtcctgcactttgccttggaggagcccaggtgtgatttgccagaacaggagatattccagatgagaggtggtgggcccagagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44848 - DNA, 1099 bp, Homo sapiens
ggcggggtttggtgagcgttgccggcgggcccgcggtacctcccgcactctgacctgcggcccgtaggtccgagccggggacggcggcgtcggtgggtcatgctccggcactccccctcgctgtgggagctggtggaggagcacgttccgctccgggagcgacgcgaagtgaagaggattctgggggaggcggcggtggacctgagcctggagctgcgggcggaggtgggagcggtcacagagatctcagcatcatcaaggaccaactgaacgtgtccaacattgaccaggtggccagacacctgaggggccttctggaggaggagtgtcacaccttggagagggagatcctcatcctgcagcgctgcctggaagaggagtatttgaggccttgccacccctctgaggcagccctggagcccaccctggcagagctaaaggaacagaagaaggccatggagcaggagctgcaggcatctgtggggccttcttgtgtctctcccaaccacaggcagcggcccttggggtcctccacacagggcctcagacccccgcttcccctctgcggggttgcacctctccagtgctgcctgcctgcacctcctctggagccctaccttcgacctcgaggccagtcggctacccaccgctggggacggcagcttcagtgcagccccagggaagggccagcttccacacccatgtccagtgcagcaccccaagccccagcctgaagggctggtcaccgagtaggctctggcttctgccacagcgcacctgtctgccgctgccgcctcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttta

SEQ ID NO: 44849 - DNA, 460 bp, Homo sapiens
agggctcattaggacccatggcagtttggtttgtagagagtgttttaatgaatcataaaacctttgtgaacttgccatccactgacatggtgcagcctggaagattttcgtgcctcctgacttgagtaactgtaaggcattattgtggtgtgatacagttaacatagggctatggagaggagaaaatatttccttttggttcataataaaaggataattattattatttggggaaagaagaaattgcctgcagaattgaaagattgcctctcaagtaacagggagagaggcatgtaagcacgtgggctacagttcaggctttcaaataacaacatatgtggttctgcttttactgtagttgtcacttttcaggtgaaaatggcttcacacatttaagggatcttacatgtctgagcaatattctataattataaaaataagtgatttatattgtgaaatt

SEQ ID NO: 44850 - DNA, 713 bp, Homo sapiens
gaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaagctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgcttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatg

SEQ ID NO: 44851 - DNA, 803 bp, Homo sapiens
gaggccccaccgaagcatccccagcaacagggactgaggcatctgaggcagccagcccactcggaaaggcctgctgactgcactccagatgtcaagagcacccttgggaaaaagaaaggcaggagtgcagcactttctagagcctcagctcacttctctccttctagctccagccggagtgatggaagaagctgcgctgggagctgcctccctgggagcctaccctgcccagcctgagagtggaggctaccagcatcacgcttcccctagtgaaatccatctgtcctgaagggaaccctgggacggggtcaaggaaaccctgttcacccccaccacggggtcaggtcttcaccaaagggaggccgcacggattcccagtcgcaaacccaaagccttgctgcctttgcctctgcttccatagttgtttcaatgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctt

SEQ ID NO: 44852 - DNA, 541 bp, Homo sapiens
agtgagtgctttgggtgtgattgacaagtttccatgacatctcccagggagtggggtcctgatgttggtgacatctctatcgttcatcttttcatggggctgatgaattcctagaaagggtagaaggagaaggagccactgaaagaggctctttaaaacttccctgagtgtcttttttaaaaatcacatacactcgagtaagactgagtctcctcaccgaagagatctggctgtatcccgagtctctgaaacctttgctccagtcccgtgggagcgtgccgtcccgaggatgtggagccgcaagggctcgccagagggatctcaggagctaggcctcaaggagcgctgttgagtgacaggtctgatgcagtagcttttactattggtggaaatcgatgttttttccttgaaagtctacctttctaagttcagtaaaccaaattagatcatgtatgtgaaagcactttgtaaactatgcagtactccagaaaaggcagccaagcccttaattataactcaccaaacagccaactctcatctt

SEQ ID NO: 44853 - DNA, 1542 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttagtaagtagctcccggaggttcgccgagcggcgcaccggagaaacctgggtgggggatggaatgggggacacttgggacgccccgcgcggtctcccttctctctttttggggccctcagcggtagccgcgcggtccaggccaccttacttcccgcgggagcgcgcaccgagtcacgagaactgccagcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttggtacgcacaagtttacaccctgagtgtgatccaccatccaaagcctcgttggttccggagcagccccttttcctccccaagctgaacaagcccagaaggctaagcgacttcgggggtgtccctgagttgccgagctcagagaaaggacccaggtcttcgtgactcattgttccgtgtaccccattgtttcactgtgtacgttaaccgtaacagaaaatagcgatgtcggtcgcttgccttcactccccactgactgcagagccttggagtggtagtatcaaagtgggccttgcattatcgctccccttttcggagcactggctctggaggctttcagttctaagcaggccctcgagttcttcacgtcttaactctgtgaccccggacgagtttaagttgctaagccttgttttttctcatccgtaaaatagggctgcaagtattacatgacattatatatgtaaagtgattagtcacagggcctaaaatataaattactattgttaataccgataatcattatagatatttgtaatttatgagagatttgcagttatgctacatgagtttagggtcgaggattattttgtgggaaagaagagtttgcctaaagtcgtgtgattataatgcaactagtactagaatttctattttcttcaaaattggttgcagttttcaccctatgccacatattttcttctatctttggttaagactgatcaggtgaacaggaagtctcaaatttctgaatggattatgttctaaaaggttaccatgtgatgattaatgggaatagtca

SEQ ID NO: 44854 - DNA, 1254 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggacactgaggctcaaggcatttttatagacttgtctaagatctggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaatttt

SEQ ID NO: 44855 - DNA, 1613 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaattttaaattaaaaacctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaaccacagattcaataaattaataaactttgtgt

SEQ ID NO: 44856 - DNA, 659 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcaggtaacatttttgttacaatggtaaaatgttcctgtcttctgaaaaaattgccttataaatcctgtgaactactgaatttaaattggttctgaggacatgtcatttggagaggtttgtaaatttggaatttattaacgtggatggagttttagtatatcaataaattttgttttaaaccataaaaat

SEQ ID NO: 44857 - DNA, 328 bp, Homo sapiens
aaagcatctttgatcattaagttgaaatatgaatgtttagtctgaaaatagcagatttttaaaagtactatttggacatagaattaattatttcttatcccatctccttttcttccttctgtgatttgcttagattgccaccaaggagccaatgaatcccattaaacaatatgtaaaggatggaaagctacgctatgtggcgaatatcttcccttacaagggttatatatggaattatggtaccctccctcaggtaacatttttgttacaatggtaaaatgttcctgtcttctgaaaaaattgccttataaatcctgtgaactactga

SEQ ID NO: 44858 - DNA, 1700 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaattttaaattaaaaacctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaaccacagattcaataaattaataaactttgtgt

SEQ ID NO: 44859 - DNA, 712 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaatttt

SEQ ID NO: 44860 - DNA, 1590 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaattttaaattaaaaacctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaaccacagattcaataaattaataaactttgtgt

SEQ ID NO: 44861 - DNA, 1635 bp, Homo sapiens
tccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaactgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaattttaaattaaaaacctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaaccacagattcaataaattaataaactttgtgt

SEQ ID NO: 44862 - DNA, 430 bp, Homo sapiens
gcctctatattcagagaggttgtgcctgtcagcctcagaccactatagttctgaggggtaacaggaatgcgctgggctgccatgacaaagcaggcagacccctgacactcagcccatcccagggagagtaggtgggatggggcttctcagctgccaagtgaccagggaaggtcatacgtaaatgagtgagaggcatccaagctccccccagatcagaggcataactgcagttgctccagcctgtgtcaaagacaaactaatccaataaaaaggagcaaagctgggcatggtgatgcacacctgtagtctcagctactcaggaggctgaggcttgagcccaggatttcaaattcgaggctgcagtgggccatgatcatgccactgcactccagcctgggcaatagagtaaaaacctcatctctttaaaaaa

SEQ ID NO: 44863 - DNA, 438 bp, Homo sapiens
ggttgtggttgctaaacagctgagataaggagatttaagataaggagattagcctggattatccgggtgggccaatttaaaggtgggtctttaagtgtggaagagggaaacagaagagtcagaggcagactgaagtgattcgatgtgaggaggacttgacccaccatttctggctttgatgatgttggaaagggccacagccaaggagtgccagcatccactaggaactggagaaggcaagaaaatgagtctcctgagagccttcagaaagaatgcagccctgccggcaccttgatcttagccccctttgggcctctgacctccaaaactgtagaaaagaaatgtgtttgttttaaggcactcagcttgtggcgatttgttacagcagcccaaggaactagtacacctgcctaaggtcacccgctggtaaaggtagaa

SEQ ID NO: 44864 - DNA, 416 bp, Homo sapiens
gtgaaccgatattgcgccactgtactccagcctgggagacaagagagaaatttcatctcaaaaaaaaaggaaagaaaaagaaaaaaccctgcttcctagtacttgccccctagcacttctagttggggtgacaaacaccagacaaggacaaggtaatgtttggaatgtcagatggtattaaatgctaaagagaaaaataaagcaggaagagggaattgggagacggggtcccggtggtcacacttacagataaggggccaggaaaggtctcatgagagggtatattgaagtcacaacctgcaggagatgaggagagcgcattaaataacagtgacctctggatcatgcaagccccttttcaatgatctttcagcactgattatgccagtgagaaatatccgaggcggatggattgt

SEQ ID NO: 44865 - DNA, 450 bp, Homo sapiens
gcaggaggagaggggcaatatttttccagccttcagcagttggacaggacaggtcaagccactggaaatggaacatgaatcttgaatccctcttcaaactttttgaaggcagggaattgtgttattttgtatttacatggtatacatcagcacataactcatacttggcccagagcaggagctcattgatgtttgtagaatgaatgagtaaatgagtccaggtgtctcttgctttcagtaaaacaggaaaagactgaaggggcactgatttgatgatgtcctctctttaagttgcttcctggaactcttagaagtcatatgaactcttatgggcatctaccttaccttttagtacaatggagtagaagttcacccaatttcacggtaaattttataggattgctttacctaatgccaccataggggtctaaaacaggtagtgcatgtttc

SEQ ID NO: 44866 - DNA, 378 bp, Homo sapiens
tcaacgtgtatagtcttaataaaataaatacctatttatctggcccaggttatacagtcacggtatgcttttccaaaatgttccatataatagttgcaaatgccttagaattatatcttacccaattcaatgacctgctggtcctagtaacccagcaaactatcatttctgatttgcatataagtttacaaacaccatgaaaggtcaccagagtatactgacaacctaaatattacagctgtaactaggcttcctcaacatgataaagggcacccgcctatgagacccacacctatgtcacacttcactgtgaaggactggatgctttcccctacgatcagtaagacaaggatgtctgctcttggtacttcaacgttg

SEQ ID NO: 44867 - DNA, 496 bp, Homo sapiens
gtaaaggatttaatattacctcttctaggagaattaacattttagaacagtagcctgcagagggcaatgtttaacccaatgaagaggctcaaattgtggactgtcaggcactgtgataagtggtagattcatggagacacaagataatcatgaccctcattgtcttactatttaagtcaccacacctttcacttattaggcatgggccacctgacttcacttttcatgaagagtagggcaagaaaagcataatggcccatatttcaagcaactggtcccaaaacacacaagctgaacaaaggaggaaacgcagacagtggggtggctggcctcttgattcacccctatcttgccctctccagcagcattccaggcaagtgccatcagctctatttattcttattccttcacacccacctagggccttaacatcactgatgaggaaatttgaaccccaaaggagttgacttagtagttgttccgggtaccagagccc

SEQ ID NO: 44868 - DNA, 369 bp, Homo sapiens
ttaaattcttaaagaggaattactaggtcaaaagataagaaattattcaaatggattctttgtactaccaggttgctgtggtctgaatgtatccccagaattcatgtgttagaaacataatctcaaatgcaccagcgttgggagatgtggggtcttttgggaggtgtttaggtcatgagggtagagccctactgaatggattataaataaaagggcttgcaggagtgggttttcgtactcttgcccttctgccttccgacttctaccttctgtccacatgatgacacagcaagaaagccctcaccagatgctggtggcttaatcttggacttccgagcctccagaactggggagacagtctggacacag

SEQ ID NO: 44869 - DNA, 263 bp, Homo sapiens
agaaattctcttaaaaatgataaactgaaacatttcatttggttaagaaaaataatagacttcatttttagtacctccctagtttccaattttcttttttttaaatatatatattttttattgtactttaagttctagggtacatgtgcacaacgtgcaggtttgttacatatgtatacatgggccatgttggtgtgctgcatccagtaactcatcatttacattaggtatatctcctaatgctatccctcccccataccccc

SEQ ID NO: 44870 - DNA, 471 bp, Homo sapiens
gcctgtcttgactttcttcctctccatggcttgcttctttctccattaggagatctcagcacatcaaaatattagctaagaagatactttaatctgagaacaaagtgacacctatttaaactaacatcaataaagacagctagaaggtttttgcacttgaccataaatgatacccaaaagctgttctaagaaaacccgattttgtgatttggggcagcctaaaagtatgtgtaataaaagagaaagagcacttaaccagagtcgggagcctcagtttctaatgctagactcattactaacgatgtcactttgggcaaatcattctatttctctggcttcattagtgacctcagtgggagcagctttagcagaaaaactgacatcataattgccaaatccataggctaattttcattcctcatcctccttgacaactccgccgcatttggcactcttgactgctcttttcct

SEQ ID NO: 44871 - DNA, 1119 bp, Homo sapiens
aaaactagagaatagtggctggcagtagttgggaggaggtcaggacactggccaccccctaagcatggtagttcctgtagtgttaaggcagccagtgtgcaggaggccgcactctctgaggagttagcgatctgtcttctgttagtgctatgcagcccagtgtttcaacagcttcccaagagtcagaaaaacctcaaatgatggatggcctggctgaagtcatcagtagagataggccccggacatggtctatctccccatcaaattcaccaaacctcagggcactgtggggttgcagggccagacagtgcccagccacgctggcatgatggcagatctccaacagtggggaactaagagtttgcccaggcatgaagaaaacgaatttatgaagttcataaatggagtttataaatgctataaacaaggggcagcatgctttcattctgtgtggatttttttgtctgctttattcatatattgttgtcagtttaattgaagtataatctacacacaataaaattcaacaattttaaggatgcagtttattgagttttgacaaacataaacagtcacaccaccccatacataatatagaacaggggttggcaggtctggctcccaacctgtgtttgttttgtacgtttttaaagggttgttaaaaagaagaagacagggatcatatgtgacccgcaaagccaaaaatatttactgtctggccttttacaggaaaagtttgttgacccgttgaccctgacagaacattcccatcccacttggagttccctctggccccttggcagggattcctcccctcccccaggcagccactgatctgctttctatagatgtagttgcgccttttctagaatttcgcatgaatgaaatcataccgtatgttgcctgttgtgtctggcttccttcacttatcatgttttgagagtcattctgaatttttcatgtctcagttctgcactccttctttactcctgagtagcatggcagggtttgactcctggggggatgggagtactccgcatgttttagccacatgcagacgcaaagaagaagaaaggggatctgcaagtgcggcggtcagggcctggatccccggggtgc

SEQ ID NO: 44872 - DNA, 417 bp, Homo sapiens
ttgacttttattgttaatgtatgctgcttgaaggcaagggctgttgtgaatttattatattgctatatattttacagagactcttgatttttccctggtttaccttgggaagttttcctgcctcttaaatggcgagaggatcctttagaagatttcctaactctcagaatcttttagatttttcatgtcatgctgtgtttgctatggccttgaaaaagcagtttttcccttttttgcagcagacacaaccaagattctggataaagaccaggcaacacaattttcctagagtaatacttaccttgagtagtttcttatggggaaaaaagcccccaatattcttaggcttaatttctatgatcaaatattttaaagatagaaacaaatgatatatagtagttaggtatgggggcaggc

SEQ ID NO: 44873 - DNA, 406 bp, Homo sapiens
aatcgcttgaacctgggaggcagaggttgcagtgagctgagatcacgccactgtactccagctggggcaacagagtgagtgagaccctgtctcacaaacaaacacccccaaaatgtctaatttggaaataaaaggaagactaatttctttattttctgaacccttgagcgttctgcatagtgatttaaagtttacaaaatatcttccatttgttgtctcttttggtctgtatgccagtcctaaaaagggggatggggtaggtgtggtgtgatggcttatgcctgtagccctagctacttgggaggttaaggcaggaggattgcttgagcccaggagtttgaggctgcaagtgagctatgattgtgtgactgcactctaatctccagcctgagccatagagctagaa

SEQ ID NO: 44874 - DNA, 2650 bp, Homo sapiens
gcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctca

SEQ ID NO: 44875 - DNA, 557 bp, Homo sapiens
tccaaagaaatatgactagggccgtcactggatgttaatttagtacgagggccatcgcactactgtgatatagcatgcacgtggttctaccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgaccccaaacgcagcgggaccctcccaagggggcgaacatctaggtgggccctagagggaagatagtatatatagggagcccccccaaggcaagtggcttagctccgccaccattcgggccgggttgctcccgaggagagttggactcatacccgggcggggggcctggccaaaaggcttctcttaattaaaagttgcctttccccgtcaaaaaaagaacagag

SEQ ID NO: 44876 - DNA, 2324 bp, Homo sapiens
gcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctca

SEQ ID NO: 44877 - DNA, 1657 bp, Homo sapiens
cctgtgccccctgcagtccaagaatagggctggtcttggtcaccccatcaacatttgtcacagcaggggctaatgagggcaccggctggggcagagtggacccctggcagctctgcctcatccttccccagtggcccaccacgacctggataacacactcaactgcagcttcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctca

SEQ ID NO: 44878 - DNA, 3562 bp, Homo sapiens
  misc_feature (2729)..(2729): n is a, c, g, or t
gcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctcaaaaaaaaaaaaaaaaaaaaaacaaagaaaaaaaaaaagggggcggcgggccgactccaagagagtatcccccacggaanggggccccaaagataaacgcgcgtataacccccagttttcttcgtgtgaacaaagagggggcgcccccccaaaatagagcgggagagccgcgaatataaaaataaagagccaaagagacgaaggggggcacccagtacgagattacacaacaccaccgtttgcggagaactggtggcgaacaaaccggctgacactagcgcgtgcgcggaaaacacttgtggggggaaaggagaaaccccttataatcatgcccgggggggcggtgatcgcacacaaaaaatgtggacgaaccagaaaactactacccactgaacaaggaaataattataaaagaggccctcataagggggaacaacatttattaaaaaatgtttttcaaaagcgtaggggaatatacgggggtgggtaaacaaccaatagggctgggtaatatatgaggatatgtcagctgtggatagagagacaacgtctggcggagaaaacggaggaggatatacatattatagggagcaacaatatttttaattaacccaggggaggttaatttgtgtacaaaaaacacgcgccacacacccaacagaacgcagacagaagcaacacaaggaaaccgacatcgacgagcgagacaagtagcgagacacgaaccagcgtacgaagcacggactacaaaacaacaagcaaaaccaaaaggcgtgcgcaggacacagagacgaggacaccgaacagacacaagcgagagccagagaaacataacaacagtagacaagacacacgcaacaaaacgccaactaggagaaagacacacacagacacaccaaggcacaaagcgggg

SEQ ID NO: 44879 - DNA, 2283 bp, Homo sapiens
ctggaccctgggccctggccgcgggtgaggggtgagggtagggggcatcctaggggggcggctgtggcatgccttgaccctatgtcccggcagctgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgccgcgcaagaagagccgggaggcggcgggcgagctgggcagggcgggcgcacccaccctgtagcaggctgtggctcgtccgcgcgcagctccctcagcttcgcagcgccgcccgccaccccacacctcccacgctaccgggcacgggcggcctcctattggccgggcaccgcgcggctagcggaggttgcgtctcattggctcaggtcctgcagccgctcctggattggagcagtgtgctctggcgggaagggcccatcccgttggtcgaggcctgacaggcgcttagcgggcgactccctccccattggccgagttatggagcgctccgaccagacagcgtctcattggccaaagatgggagggttccgcttaaagaccgcctcttactggccaggagtggacttggttagggctaccttctcattggttgcagccagaggcacttctgcccgggctgcctctcccccgctagggcctggtgcctctggctggaggctccctcccttggccgtcccaatagagcccggggctacttccactggccaggctcccgggcatctggttgaccccagcctggggaggagggctggtctccgctcctcaggggcttagtccgtcccaccccttcccttccctggcgccccgggcccaggcccctcagctgtcagctggttttgatggcctcccactgccccacacgccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctca

SEQ ID NO: 44880 - DNA, 1945 bp, Homo sapiens
gcggccgctgccaccctgtggacggcacgtgtgcctgcgagccgggctaccgcggcaagtactgtcgcgagccgtgccccgccggcttctacggcttgggctgtcgccgccggtgtggccagtgcaagggccagcagccgtgcacggtggccgagggccgctgcttgacgtgcgagcccggctggaacggaaccaagtgcgaccagccttgcgccaccggtttctatggcgagggctgcagccaccgctgtccgccatgccgcgacgggcatgcctgtaaccatgtcaccggcaagtgtacgcgctgcaacgcgggctggatcggcgaccggtgcgagaccaagtgtagcaatggcacttacggcgaggactgcgccttcgtgtgcgccgactgcggcagcggacactgcgacttccagtcggggcgctgcctgtgcagccctggcgtccacgggccccactgtaacgtgacgtgcccgcccggactccacggcgcggactgtgctcaggcctgcagctgccacgaggacacgtgcgacccggtcactggtgcctgccacctagaaaccaaccagcgcaagggcgtgatgggcgcgggcgcgctgctcgtcctgctcgtctgcctgctgctctcgctgctcggctgctgctgcgcttgccgcggcaaggaccctacgcgccgggagctttcgcttgggaggaagaaggcgccgcaccgactatgcgggcgcttcagtcgcatcagcatgaagctgccccggatcccgctccggaggcagaaactacccaaagtcgtagtggcccaccacgacctggataacacactcaactgcagcttcctggagccaccctcagggctggagcagccctcaccatcctggtcctctcgggcctccttctcctcgtttgacaccactgatgaaggccctgtgtactgtgtaccccatgaggaggcaccagcggagagccgggaccccgaagtccccactgtccctgccgaggcgccggcgccgtcccctgtgcccttgaccacgccagcctccgccgaggaggcgatacccctccccgcgtcctccgacagcgagcggtcggcgtccagcgtggaggggcccggaggggctctgtacgcgcgcgtggcccgacgcgaggcccggccggcccgggcccggggcgagattgggggcctgtcgctgtcgccatcgcccgagcgcaggaaaccgccgccacctgaccccgccaccaagcctaaggtgtcctggatccacggcaagcacagcgccgctgcagctggccgtgcgccctcaccaccgccgccaggctccgaggccgcgcccagccccagcaagaggaaacggacgcccagcgacaaatcggcgcatacggtcgaacacggcagcccccggacccgcgacccaacgccgcggccccccgggctgcccgaggaggcgacagccctcgctgcgccctcgccgcccagggcccgagcgcggggccgcggccccggcctcttggagcccacggacgccggcggtcccccgcgaagcgcgcccgaggctgcctccatgttggccgctgagctgcgcggcaagactcgcagcctgggccgcgccgaggtggccctgggcgcgcagggccccagggaaaagccggcgcccccacagaaagccaagcgctccgtgccgccagcctcgcccgcccgcgcgcccccagcgaccgaaaccccggggcctgagaaggcggcgaccgacttgcccgcgcctgagaccccccggaagaagacccccatccagaagccgcgggacctccaggggcgactctagtggcctgaggagatgtatttataggcccccagcagggctgctcccccctcggccggtgccccaggatgggctcctcccggcgggggcttggccaaagctttcttaataaaatgcctttcccctca

SEQ ID NO: 44881 - DNA, 162 bp, Homo sapiens
cagattgcaggggatcgcggatggagagacaagtcggggggactttacccccaggatggggaaaagtcacccacaattcaagcaaagatgacccttgtgacagattaacatttcagggccgctacctggagaatggacggctcgggacacgcgtgggagccg

SEQ ID NO: 44882 - DNA, 1261 bp, Homo sapiens
ggtgtctttcggggataatgaaaatgttgtgaaattagatagtggcgatggttgcataacaccatgaatgtactaaaagccactgaaacttatacttcagaacggctaaaatgataaattctgtgatgtgaattttactgcaataagcaaaacagtgactgtgtcttaccttccttccaaaggtttactagaaactgtgcaagctgtttcataatcacaatgttgagaactggaaaggatgatcctttttaaagttggggaaccactagcccaacatcgccatgaggggaaatagaggccgtgtcagccccaaccatcaaaggagacctttgtgcactgggtttgctgtaaatgacagaagccacttcaaaagcctctttggagctgttcagtaaaatgctcagggaacacctgggcacactcaggcaagataaaccacacagacacctcgcagacagacctcccaggacagagggacagcaacaagactccaaaagcaacttgaagttttggcagcatgatcatccacagagtgaagttcaacattcagtcaagaagaatcattctgattacttaattggaagatctgatacttctgaaatgaaacatttcacaaactctactgaaataagaaatacttttgatttattttttaaaaaatgaatcattggttatggaaagaactatatggtcttgcagacaggacaaagttaaagatgttttgcaagcttaacacaaccaaatctgatttgagaattattttgaggcttgcagctctgttttgtttgtggcataaatatatacatacatacatacgcaggtatatatgtatgcaaaaatgcttattgactgtggaaatgacagtttaagtcactctgtatttcttttttccatgagtctaatattgaattacgatgattcaaaggctctcagagtgttgtgctaacatcgtaaatggctaaacatccaaaaaagaaaacaattaaaacacaacgcacacacaattttcttaaagttgtggaaaattaggtaggcacagttgattgttttgagctggtagaaaaacctgggcagctagcagaggtctggacaaccacggaaagcccacagcaaggaccacaccgtgagcagccaccagagatttgggatggtagacttaccaagagtgtccactggcgggggggcacacggtgagaaagtgcaggatacacaattgacacaaaaaggaaaataataaagtcaaactggtattcaagcagca

SEQ ID NO: 44883 - DNA, 175 bp, Homo sapiens
acatgagggatacactaaaaggcaaagccctcaggagagagttgagtgaatagatcactagcactggggttacaaacaattcacgaaagaggaaatacaaaagactaagaaagatttggaaagctattcaacctccctaatagaagaaaagtgcagaattaaaatagcaatgtga

SEQ ID NO: 44884 - DNA, 619 bp, Homo sapiens
aggaacgtcctaaaacaggagcaaggtggttaattcagctagtgctgagatttccagccaccagagggctattctgacatggagggcacatttggggagtggtaataataaagggctattgcttcactgcttgaagcaccaataaggcacagttacctccttgggaaagcgtggccaatggctcacagagtgactctctggccttatggctaagtaaattcagtaagtcaatatttcctgcttatttgaaaaaaaaaaaaaaaaaaaaacaacaactagcaagtgctcatttccaaatgctaacaactctaccaataaaaatacagttatgggccacataatgacattttagtccacgacagaccaaacatatgatggtggccccataataccgtattttttactgtaccttttctatgtttagatacgcaaatccctgccagtgtgttacaactgtctatagtattcagtgcagcaatatgctgcacaggtttggagcctaggagcaatagttgtaggtgtgtagcccaggtgtgtagcagactataccatctagatttatgtacatgtactttatgatgtttgcacagcgatcaaaccgccccatgccacatttctc

SEQ ID NO: 44885 - DNA, 337 bp, Homo sapiens
tgattgaaggacagataaaaggaaatattggataatattggagattagggaggtatatcaccaacagacatgatataccaaatcaaaagaattgttagatggctctggaaaaagaggaatatagcattcagacagctttctatgaatgtagactgtttcagttattcaaaggcctgtttacctggcctttatattcgtcaggttggctgtggtactagatacagtgttatgggaacttgccgcaaaccttatactgttgccctatacctatttctcttttctgtaccacctgatttcactttgatcatgactttatttagttgatacatcaattttt

SEQ ID NO: 44886 - DNA, 294 bp, Homo sapiens
gaagagctgggcaccatgggctatgcaagtctagtcctagccagttggaggccgaggcaggaggatcgcttgagcccaggagtttaagcccaactgggataacatagcaagactctgtctctaaaatagatagacagagtaaatatgtacaaacagaaaatacagtggggatactactaccttacagaaactaaaaggattatgataacatgaataataattcttcaaaaattagataattcaggtgaaatagataaatcttagaaacacacaaattactaaaactgattacag

SEQ ID NO: 44887 - DNA, 515 bp, Homo sapiens
tatacttggtgttaatagcaggaaaaataagttcttggtttgaaaaatgctcctgcaagtttttgtgaagcagcctctctctaaacgtcatgatctgatctgaatgacgacagaatttgtaccaacctatcacattctttttgacattggagaatattttcttcagtgcttgctcatttacttcacttgaggaattataaaagctaaaaaaagcatggaatatatttctgaatgtcaattgtataaacaacttcaacatcatccatttgggaatcagtaatgctattcttgccttcatcttttacttccttaagaagaacaccttccgtgtcccagacagtgctggggttgtgtaaggcaagctggtcaacacaaagcccaagaacacctgctcttacccttcgtgctgccgtcagctcaggcttcaggagacctaacttcacaacttcattaatctaaaacgcgtctaaaacagtttatagaaaaggaaatcctctcttttgtaaaaaaaaaaa

SEQ ID NO: 44888 - DNA, 458 bp, Homo sapiens
tagggatgtaggccacctccttcattttacaggtgagtatggcagcttctttcaaaagatttctcctcccctcctcatcttatgtaagaccttctactgaacctgagctgccccatcacttcttcattacccagagaatgtggcagaaatgatgttgtactggttccacgtttaagagaccaaagcctggcagtctcttagaattcacactttagtggacaggcatgatggctcacacctgtgatcccagcactttgggaggccaaggcaggaggtttacttgaggccaggagttcaagaccagtctggtcaacagcaaaatcccatctctacataaactttttaaacagtatgcaaggtgtagtggcgtggtgatgcatgcctatagtctcagctgcagtgagctatgatcctgctactgcactccagcctgggtgacaatgcaagtccctatctta

SEQ ID NO: 44889 - DNA, 266 bp, Homo sapiens
tgtttatgataagaagataattggacacttaaaagataattgtacatttaaaagatttaaaagatgcatttttgtttagaaaggactcttacaacaattataaaaaaaacagaccaggcgcggtggctcacgcctgtaatcccagcactttgggaggccaaggagagtggatcatgagatcaggagttcgagaccagcctggccaacatggtgaaaccccgtctctagtaaaaatacaaaaaaactagccaggcatggtgatgtgt

SEQ ID NO: 44890 - DNA, 2724 bp, Homo sapiens
  misc_feature (1906)..(1906): n is a, c, g, or t
cggctaggtcgaggcgccgtggtaatcggccgaggacctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaatgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctngtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctcaaaaaaaaaaaaaagtctaactcttctgcttgtctttacaatgctgtacagtgagagctaatgtttataaggataaacaggatacttacagggatttgaaggtaatttaattcagtggtttccaactttttaatcaccaaggccttctttttactcccctatgtcctgtgtcttaaaagattatgtttaccaaactgcatttattaaagaattatattttgctacataaaggcatgtacaacacaaatcatgcttctgactggcaccatgtaggcagacctaggtactaaaattccagcccaaagcaaataatttaccattttcattagtctttttattccttttgtgggcaaacatatcgtctatgttaggctttttgaaatattaactatgacttgtaaactccagattaaaaactaaccaattcatctttgatggagcttgaatcaaactaagggtattggacttttgaaagattgaaatttttgttacagtatggaatgtttttaactgaatgttgaaataaaagttatttaagaattac

SEQ ID NO: 44891 - DNA, 660 bp, Homo sapiens
agagctggcggccgcggcgcctgcgtccaccggcaagcgaggagtggagcagagctcatatgcctatggggagaggcctgggggaccgcaggaggatgtaggcgccgggtgcgcatgactgggccttcttgctctcggtcggcttcttggtctcggcgtgccccattcccggccctgtcccgctactcttgcctgttccagttccctcctgtgggtaccgctaacggcatcttcccgaggcccagaatccaccgtcaggcataaattgattattcctcgcccacatctgtgccaggtatatttgtatatgtaaccaaatctggtttttgcatcccacgagtgaccccgctggggaggctagactaagccacaggaatgaactgtattgttcatatatgttctactactaagtctaaaatattaggactgttagagttcaaacaagggagggatttaggtgggctggtctctttgtaagggtctacattgcttttaggagcagcttctattgtgaccaagcgagttacagagaaacgccacactttgagacaaattaaagagtccttattagccggcaaccgagaggcagctagcgcccaaaattttctcggccctgaggaaggggctagttttgtttttataccgtggtctaaatagggg

SEQ ID NO: 44892 - DNA, 5038 bp, Homo sapiens
  misc_feature (1974)..(1974): n is a, c, g, or t
  misc_feature (4220)..(4220): n is a, c, g, or t
agagctggcggccgcggcgcctgcgtccaccggcaagcgaggagtggagcagagctcatatgcctatggggagaggcctgggggaccgcaggaggatgtaggcgccgggtgcgcatgactgggccttcttgctctcggtcggcttcttggtctcggcgtgccccattcccggccctgtcccgctactcttgcctgttccagttccctcctgtgggtaccgctaacggcatcttcccgaggcccagaatccaccgtcaggcataaattgattattcctcgcccacatctgtgccagattctgaagacaggaataagatgaaggaatggaaatcaaagatggaaatttctgaagaaaagaagtcagcaagggctgcatccgaaaaactccaaagacaaatcacccaggaatgtgagttagttgaaaccagtaattctgaggacagattattgaagcactgggtaagccctttaaaggatgcaatgagacatctcccttcccaagagagcggtatcagggaaatgcatattatcccccagaaagccattgtgggagagattggccatggatgtaatgaaggagaaaaaatactttctgcaggagaaagctcccatagatatgaggttagtggccaaaacttcaaacagaagtcaggattaactgaacatcagaaaattcataatataaataagacctatgaatgtaaggaatgtgaaaaaaccttcaacaggagttcaaacctgatcatacatcagagaattcatacaggaaataagccatatgtgtgtaatgaatgtgggaaagactctaatcaaagttcaaatcttattatacatcagagaattcatacaggaaagaaaccttatatatgtcatgaatgtggaaaagacttcaatcagagctccaatctggtgagacataagcaaattcacagtggtgggaatccctatgagtgcaaagagtgtgggaaggcttttaagggaagctcaaaccttgtcctgcaccagagaatccacagtagggggaagccatatttatgcaataaatgtgggaaggctttcagtcaaagcacagatcttattatacatcacagaattcacactggagagaaaccctatgaatgttatgactgtggacagatgttcagtcaaagttcacaccttgtcccacatcagagaattcacactggagagaaacccctcaaatgtaatgaatgtgaaaaagccttcaggcagcattctcaccttactgaacaccagagactccacagtggagagaaaccctatgaatgtcacagatgtgggaagaccttcagtgggcgcacagcttttcttaaacatcagagattgcatgctggagagaaaattgaagaatgtgagaaaaccttcagcaaggatgaggagcttagggaagagcagagaattcaccaggaagagaaagcttattggtgtaatcagtgtggtaggaatttccagggcacctcagacctcatcagacatcaggtaactcatacaggagagaaaccatatgaatgtaaagaatgtgggaaaactttcaatcagagctcagaccttctgagacatcatagaattcacagtggagaaaaaccttgtgtatgtagcaaatgtgggaaatcttttaggggcagctcagatcttattagacaccatcgtgttcatactggagagaaaccctatgaatgtagtgaatgtgggaaagcctttagccagaggtcacaccttgttacacaccagaaaatccatactggagagaagccctatcagtgcactgaatgtgggaaagccttcaggcggcgttcactccttattcaacatcggagaattcatagtggtgagaaaccctatgaatgtaaggaatgtgggaagctcttcatttggcgcacagctttcctcaaacatcagagcctgcatactggagagaaacttgaatgtgagaaaaccttcagccaggatgangagcttaggggagagcagaaaattcaccaggaagcgaaagcttattggtgtaatcagtgtggtagggctttccagggcagctcagacctcatcagacatcaggtaactcatacaagagagaaaccatatgaatgcaaagaatgtgggaaaactttcaatcagagctcagaccttctgagacatcatagaattcacagtggagaaaaaccttatgtatgcaacaaatgtgggaaatcttttaggggtagctcagatcttattaaacaccatcgtattcatactggagagaaaccctatgaatgtagtgaatgtgggaaagccttcagccagaggtcacaccttgctacacaccagaaaatccatactggagagaaaccctatcagtgcagtgaatgtgggaatgccttcaggcggcgttccctccttattcaacatcggagacttcatagtggtgagaaaccctatgaatgtaaggaatgtgggaaactcttcatgtggcacacggctttcctcaaacatcagagactgcatgctggagagaaacttgaagaatgtgagaaaaccttcagcaaggatgaggagcttagaaaagagcagagaactcaccaggaaaagaaagtttattggtgtaatcagtgtagtaggaccttccagggcagctcagatctcatcagacatcaggtaactcatacaagagagaaaccatatgaatgtaaagaatgtgggaaaactcaatcagagctcagaccttctgagacatcatagaattcacagtggagaaaaaccttacgtatgcaataaatgtggggaatcttttaggagcagctcagatcttattaaacaccatcgtgttcatactggagagaaacctcatgaatgtagtgaatgtgggaaagtctttagccagaggtcccaccttgtcacacaccagaaaatccacactggagagaagccctatcagtgcactgaatgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaatgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcctcccaaagggttgggattaccggcatgagccactgcaccagccccaggggtctaattacttgagaatgttttaagggatgtctatcattattaaaatcattataaatcactttggcaacaaccccaaaactaaattattcatggaaagagccatttcaatcttgacttcctagtcgagtgacaagtttaaatgtgggaaaaaaccctgtgaaagtaatgagtgtaggccaggtgcggtggctngtacctgtaatccagcactttgggaagccaaggtgggcagatcacgaggtcacgagttgatcatgaggagttactatgcccagccaacatactaaaaccccgtctctactaaaaataacaaaaattagccaggcatggtggggcacgcctgtagtcccaggtacttgcgaggctagggcaggagaatcacttgaacctgggaggtggaggttgcggtgagccaagatcatgccactgcactccagcctgggcaacaagtgcgaaactccatctcaaaaaaaaaaaaaagtctaactcttctgcttgtctttacaatgctgtacagtgagagctaatgtttataaggataaacaggatacttacagggatttgaaggtaatttaattcagtggtttccaactttttaatcaccaaggccttctttttactcccctatgtcctgtgtcttaaaagattatgtttaccaaactgcatttattaaagaattatattttgctacataaaggcatgtacaacacaaatcatgcttctgactggcaccatgtaggcagacctaggtactaaaattccagcccaaagcaaataatttaccattttcattagtctttttattccttttgtgggcaaacatatcgtctatgttaggctttttgaaatattaactatgacttgtaaactccagattaaaaactaaccaattcatctttgatggagcttgaatcaaactaagggtattggacttttgaaagattgaaatttttgttacagtatggaatgtttttaactgaatgttgaaataaaagttatttaagaattac

SEQ ID NO: 44893 - DNA, 414 bp, Homo sapiens
ggctctctcaatctactaggagtggtcttgctcttctacctgctttcatataccctgccttccttcggctgcttctccctggagctttttactttgtggcattatgcccattttttaaattccttcactgtcatttttattggtattctggaaggggaagagataacatgttttcaatttgccttatttaaccagcagtctcaaacccatttactgtgcaatgttataattataaaaagcttacttactggttgcctaatctgggctttgatacttatcacgtgcttaaccttgggttagttacagaccctttcttaacctcagaatcctcccggctcctaatgtatctaatccatataacaccatcattgacctgggaggggtattatagttgacagcaggcatgttactggc

SEQ ID NO: 44894 - DNA, 373 bp, Homo sapiens
attaaaatatatacaataacatataagatacccaagtaacaagctaagaaaagagtatgtactcaacaaatgaaataaaagcccatttcatttctgcctacattttttcagagaatgtttttaaaagacacccctgggtacagtggttcacacctgtagtcctagctacttgagagactgaggtaggaggatcacctgagcctggaacttcaagactggcctgggccaaaaaaacaaaaaagatactcctgggaaatctccttgagaatgtttctcaattctgccctcagttttccaggggagagaatacttcctgatccagccacatgtagttttctaatctgctagatgtaaattacatgaatattaaaag

SEQ ID NO: 44895 - DNA, 370 bp, Homo sapiens
tgtctcatatccaaatagtaatagaggctcaagcattagaaattgaagtcagtagggacaacttccaactagtctttaaacattctagctgctgtctaattaaagaaaagatgagggatttaaaaataacaaaaccattgtctctggagcctctggtccttattctccacctatctccttttccttttccacccacaaaagaaccttaatattcctgtcctaaaacatactcctttcttttctctgacttctgctagtctctttctcctctagagtataatcccagtttttatcctttacaaacacatgaatacaactaagatgtgtggctgggtgtggtggctcacgcctgtaatcccagcaccttggg

SEQ ID NO: 44896 - DNA, 424 bp, Homo sapiens
tcaggaaaggtcatggggaaaggggagttagaattggatcttgaaccatgacaaggatttaggcaggtagaaatggggagagagtgtgctaagtagagcaaagaggatgagaaaagggcaccaatacaggtgctgggggcaccagcagcactgtgggaacaccagttcttagtgtgctactgcagggttatgtttattgcacatttttcatttaaatacctttagaattgtctctgcttatttttcagtcaaagcattaatcaccattattaatatgttagcccgtctgttctcgctaaggtggtgttacctttctctgaagaaggtcatgctgtagctagtggtgtcagtgggttggacgcaggcattgccagactgcaatggtgttaagccacagtagccatttcctattaatcacgtaaag

SEQ ID NO: 44897 - DNA, 448 bp, Homo sapiens
tgagaggcaaggtccaggttggaaaccccctccctgcttctccagctcctcagtttctaaattctcagagataaagggaaaacacctgcagaaagtaactaagcctttttggagaaactcttgggaagaccaaagtcagggaaacaaacagctatacaattcatggtttttgcatcaggcaatgatagaaaccagcaattcatgccttgtacctgaactaggaaagccttttcttttctttttttaaagcacaacccaagtctcctgccagatcatggcttttaatttaagtgtacagttactgctcaaaagtgattcacaagcctttaaagagccactctcctttagaagtctgtttagaatgcagagggtttgaagattagtgttgggagtgagagcatttgactgcctaagtgttcaatctcccaggtacttagatatttctcag

SEQ ID NO: 44898 - DNA, 380 bp, Homo sapiens
atgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcattt

SEQ ID NO: 44899 - DNA, 444 bp, Homo sapiens
cttttgcctgttaaacctctgctcctaaaaacaaaaacaaaccaaaaaaaatacctaaatcggttactgttaatggtttttcaagtttccaaaataagaaaataagaagagtgtgcatctggcttcctaggtatgttgctcttccccaaactcctgagggcaccataggggacagagcctctgttccctggagctctccaggcccctgtgccaggcactgccctgagcctacacagggtggttttcagagaaggggtgggagcatctgagtggtcccagaagtccccaaagctgctacctggatggctcctaagcacacttctccaggtgactcacaggggccaagaagtgccctcaacaagatctgcttctattccattattctttaattcactctgggatatcgggccacatcaagtcccttcatccagctccccaggagtt

SEQ ID NO: 44900 - DNA, 396 bp, Homo sapiens
tctaatcctttagacaaaatactattagctcttccttaataattatttatctttctttcttttggagtataggtatcgacatagacatagatatatagatatatagacatagatatagagaaatagtctcaactaggtctaagtgttttgaagaaaaagagggccatgccagttgagtctgcaatgctgccagttgagtccaccatattggtaaggatatccttctcaatccaccacaatcagaatgatacttctacaacacaagtcttgtcctattacctgccccacaaacacacacatttgggacaccttcctgcttaccttcactttatgtcttcccttttattaaagaactgaatctccatcctcatctccaatcaaacccattctcaccat

SEQ ID NO: 44901 - DNA, 1210 bp, Homo sapiens
agcggatgacgcgcacaaggcgctcagcgatgacgcgctagttcggcgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgcctgccctcccggcccccaggcatacgaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatgctggagagctcccagactttgctcagtgtcctgaagagggaagctgggaacctgaccaaggctacagcctcagaccagaaaagtagtggtggcagggacagctgaccagaccatgggcagggcctgcctctgtgcgcccctcaactcagccccagcaagtctgtccacagagcgtcttcttcatggcagcagctgccttctttcactgtctcaggtgctaagaggggcagctgccaacctccactggcatcagtgacaagcccggggcacagcctgtgggtcctggctttgtgctcacacaggctatggggagggtgggctctaggtcagctctgcaaggggcctgtctctgcggcacccacactcctgggctgccagggaggtcctggttgtagtctgagcaccatggaggtcccctcagccagcagaggcccagggcagggggcaggggttctccttcatcccagaacccaaacctcagggctcacccctgtggcctgtgactgtcaataaagattatctttgtaaaaataaaaa

SEQ ID NO: 44902 - DNA, 788 bp, Homo sapiens
cccagcagggcatggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatgctggagagctcccagactttgctcagtgtcctgaagagggaagctgggaacctgaccaaggctacagcctcagaccagaaaagtagtggtggcagggacagctgaccagaccatgggcagggcctgcctctgtgcgcccctcaactcagccccagcaagtctgtccacagagcgtcttcttcatggcagcagctgccttctttcactgtctcaggtgctaagaggggcagctgccaacctccactggcatcagtgacaagcccggggcacagcctgtgggtcctggctttgtgctcacacaggctatggggagggtgggctctaggtcagctctgcaaggggcctgtctctgcggcacccacactcctgggctgccagggaggtcctggttgtagtctgagcaccatggaggtcccctcagccagcagaggcccagggcagggggcaggggttctccttcatcccagaacccaaacctcagggctcacccctgtggcctgtgactgtcaataaagattatctttgtaaaaataaaaa

SEQ ID NO: 44903 - DNA, 515 bp, Homo sapiens
gcacagcaagaagtaaaagtttctttattctcagaagacatgatacatatatagaaaatctgatagaatctacaaaaaatatactagaactagtaagtgagtttaacaaggttgcaagatacagcatcaaggtacaaaactatatgtatttctatatactagcaaataaacaataggaaattgaagttttttggctggctgaagtaactcatgcctacaatcctagcactctgggaggctgaggcaagagtatcacttgaggccatgagtttgagattagccttggtaacacaagactcccgtctctacgaaaaaaatttttttaaaaaaattagccaggtgtagtggtacacacttgtattcctagctacttgagcctaggagttcaaagcttcagtgacctatgatcacgccactgcactccagcctaggcaagagtgagtggcatcgataaacaccagtggcatcgataaacaccagtggcatcgataaacacccggtggcatcgatgaaca

SEQ ID NO: 44904 - DNA, 560 bp, Homo sapiens
tcaccataagcccttccctcaggccccttcttcagcattccttgcttctcagcatagcccgagaacccccgatccctgacactttgcttcttctcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccagggaaggcggtacatctacgaaagccctaatcatagagggaaagactcctcgttcctggcccagaaatgagatgagaaatccagggccccgtacaggaaggcctttcgcaaagtccagactcaattgccttcgcagcccttaaagtttccttaggaaggtctgtgggagaacgaggttggtttaggaattggcccctgccttgtactacgtagttttgtcatccaaagtgttttagaagtgaattgaatcatagttacgccttattttgaaacactgtaattcagagaacgtaaaaccttattaaaatgcctcataatcat

SEQ ID NO: 44905 - DNA, 413 bp, Homo sapiens
tcaccataagcccttccctcaggccccttcttcagcattccttgcttctcagcatagcccgagaacccccgatccctgacactttgcttcttctcagctcccagatggatcctggacaggatgctgcaggtggtgcaggaggggaatcctgccccatttatcatcaacacagtaaaaaggggtcgaagagaccgagagcgccagaggacgccatgggctccacatccacttggattccagggagtaagcctctcgacttcaggagtaagcaaggccaaccgtttggtttgagcctgttgcttctaagaaaagcgaggaaaaatcctgagacctcctcccctcgcccttcatccacttcaggggaccgagtgtctccacggaacttcacaagggaggaaaagagtgaactcatt

SEQ ID NO: 44906 - DNA, 458 bp, Homo sapiens
gcattcaataaatattgagtgaatgaatcaatacctcctatcctctaggcccatggctgggtgacaactggtgccagtacaggttatgttcctgggcgtatccagatgtccttcttggggaagggcagtgctgtattgcacaaactcacccgggaacctttaggaaccatccataggtgactggctccctccttagcattccctaaatatcatgctgacctcaggtgcggtgctggccacctgccttaggatggtttatacagatatcccttactggacagggagccactgtgggaaggatcgtgtcaaccttcactttttacccaacactgagaattggcatgtaatgagcactcagcaaatgtccactatctcctttcatgtacaacatccagaacattccctcaagaatctctcttgtcccagaaggaatcctgtctgtattcactatcctaggg

SEQ ID NO: 44907 - DNA, 2684 bp, Homo sapiens
acatctcagtcctccatccccctaccagataaaaggggggaagctgagcctgacttgatcatcctgccccggttctttcctccagggccgcatttctctgcctctctctcctgccatgtcgtaccactctttccagccaggctccaggtgtggcagtcagagtttcagctcatactcggctgtcatgccccggatggtcacccactatgcagtgagcaaggggccatgccggcccgggggtggtaggggcctccgagctctgggctgccttggctcacggagcctgtgcaacgtgggctttgggaggccccgggtagcctccaggtgtggaggtaccctgcctggcttcgggtaccgactgggagccacctgtgggccttctgcctgcatcacccctgtcaccatcaatgagagcctgctggtcccactggcactggagatagacccgactgtgcagagggtaaagagggatgagaaggagcagatcaagtgcctcaacaaccgtttcgcatctttcatcaacaagttcctggagcagaagaacaagctgctggagaccaagtggaacttcatgcagcagcagaggtgctgccagaccaacatcgagcccatcttcgagggctatatcagcgcccttcggcggcagctggactgtgtgtccggggaccgcgtgaggctagagtcagagctctgcagcctccaggctgcactggagggctacaagaaaaaatacgaagaggagctctccctgcgtccctgtgttgagaatgagtttgttgccttgaagaaggacgtggacacagccttcctgatgaaggctgacctggagaccaacgcagaggcactcgtgcaggagatcgacttcctgaaaagcctgtatgaggaggagatctgcctgctccagtctcagatctctgagacctcggtcattgtgaagatggacaacagccgggagctggacgtggacggcatcatcgctgagatcaaggcgcagtatgacgacatcgccagccgcagcaaagccgaagcagaggcctggtaccagtgccggtatgaggagctgagagtcacagctgggaaccactgtgacaacctccgcaaccgtaagaacgagatcctggaaatgaataaactgatccagcggctgcagcaagaaaccgagaatgtcaaagcccagcgctgcaaacttgagggtgccatagctgaggcagagcagcagggcgaggcggctctcaatgatgccaagtgcaagctggcagggctggaggaggctctgcagaaggccaagcaggacatggcctgcctgctcaaggaatatcaggaggtgatgaactccaagctgggcctggacatcgagatcgccacctacaggcgcctgctggagggtgaagagcacaggctgtgcgaaggcatcgggcccgtgaatatctcagtgagcagctccaaaggcgccttcctgtacgagccatgtggggtcagcacgcctgtcctcagcactggcgtcctcaggagcaatgggggctgcagcatcgtgggcactggtgaactctatgtcccctgcgagccccaggggctactgagctgtgggagcgggcggaaatccagcatgacgctaggagctgggggcagctcccccagccacaagcattagcatgatccgagacatccaggagacagagcccctgccccatggccctggatgtcacactcccaccagggctgaagacaaggatgttccaaaaccccacctccctttattgactccacattcccctccagtgttccctccttgagagctgagctgcccctaggacccctcctttgcctcatgagtcaccttccactcacctgtgtgcagaccctcagctaggcccagatggtggggacagacggcagagaaagagcatgcattgctcttaaccgcagaatggcaataacccccaaaaggtcaaatgggcacaccacagttctgctctgtggatcatcccatggaagtttcctcacaaagtcagctcctctcccaccacaggctcacactgcccttactttaggctctcatgcccctaagaaaagtgaatttcctttaacaccgcctgaaacatgcacgctgcaaatatcaaaaggagacacccccaaatcccactctaaattccaaagccaagtgccacgatttcaggatcagtcaggacctgccaatgtcctctcagcacagagaatcaagaggtggcctttgggcagtagatttactttctcaggtatgttgaacccaaactgtgagaataaatctttctcctgagctcacattggcaggtgatgtcaggccaatgcctagaacaaagggcaaagggatatggaatgtttactggacagttggaaaaccaaaaacagataccatttgctcaatggaatcagttccccctccacccatccccttctgtacatagccgccccttcctgttccccaaccctttagctccttttgctttgagtctgatatgacagtgatgtggggctgccccagctgacttggaggccctggctcaggagctcatagatggaggaggtgtgggctgactacctcccagaagcccctcatgccaagcctgtcccactggggctccagggcctctgccctgaacatctgggcttctgttcaaaataaacctactctgttcatggattat

SEQ ID NO: 44908 - DNA, 416 bp, Homo sapiens
tgtaatttcttttcaatcaattcactgatcattaaaaactggtaaaacagactgttgaattttaggattaagagatatcagctgtctaagaacacagaattttctcatttattatcttgttataactaagccttatttttctcattagagaaaaatgctggctggcagtgttttccagacttagcatattactgctatctaataagaatgccaaaccacagctttctcctagcacttatgtggcaagagtgctagtcttctcatctgtctctaccttttgttctccatattcctacctcagcagtatagatcaagagaagcacttgacaaagagtttgaatttaaatgattaattcctgacacactaggctaatgcccagctcatttgatcacatttgatagactgtgattgtttt

SEQ ID NO: 44909 - DNA, 300 bp, Homo sapiens
tctcatccttattactgccatagcccttctagtttcacagtgaggtggctattttatgatttgtatttttacatttctgctgtcatatatatttttctctcttttaggcagctctgacctgtgatatgttcaaaattgtattaaggttttagttacagatactctggttgggtagtggagctcaaaccaaaaccaaccttctctctttggtggtggaaatggaagctggcacattctgtgttccagtatgtcctggggcctttttatgagtagctgcatttcttaaaaattgcctgtgat

SEQ ID NO: 44910 - DNA, 1141 bp, Homo sapiens
gatttttggaaactaaaaatacaaaaaattacctgggcaacaagagtgaaactccatcgcaaaaaaaaaaaagaaggggcataatttgtggatgaggattggatataaggtaaaggatgggacattcttggacttacagatggtgtgattgcctggctagaagaagaattcccggtcaaaaagaaaccatcagctttccaagtgtgaaagagagataaatctgtgaagattatagggactacaggaaacttaatctttttctttgaaaaagcaattgtagcaaaaaaaaagaaaatttcttactgtcatctaaaattgacatggacatcttagtggactagaagttaagggcataaattctcccagtgatttttaattttagcattgtgattaacaccttctaaaattgccagaacttaataaataattgcttttcattattagtatgccatcaaatttagtagctgtttcaggctttaatgtgtcaagcctaaaatccagatttttgaggatcttctccctcttaaaagagtattcagttaactgccgtagaaatacacatgtatacaagggcactgtatacatcagtctaaaaaataaaaatatgtatacgttctggtgagtctagcacagcattgcccaatagaaatacaatggaggtcacaaatgtgacccatatagttaattgtaaattttctaatagccacattaaaaagaaaacagcacaaataaacaaatgagaaaatctatttaactcaatatattcaaaatatttcatcatgcaatcaatataaaaaatttctttttgttggtcatgatggcctgcgcctgtaatcctagctacttgtgaggctgaggcaagaggattgcttgaggctaggagtttgtgactagatgggcaatatagtaagatgtcatcttttaaaaatgaaaaaattagctggccactgtggcacacgcctgtagtcccagctacttgggaagctgaggtaggaggattgcttgagcccaggagttcaaggctgcagtgagctatgattgtgcttatgaatagccactgcactccagtctgggcaatagtgagtcggtcaaattccatttccccctccgccccatacctcttcaaatgtttaaaaaaaaa

SEQ ID NO: 44911 - DNA, 1105 bp, Homo sapiens
tactactactaaattcgcggccgcgtcgacaaaaaagaaggggcataatttgtggatgaggattggatataaggtaaaggatgggacattcttggacttacagatggtgtgattgcctggctagaagaagaattcccggtcaaaaagaaaccatcagctttccaagtgtgaaagagagataaatctgtgaagattatagggactacaggaaacttaatctttttctttgaaaaagcaattgtagcaaaaaaaaagaaaatttcttactgtcatctaaaattgacatggacatcttagtggactagaagttaagggcataaattctcccagtgatttttaattttagcattgtgattaacaccttctaaaattgccagaacttaataaataattgcttttcattattagtatgccatcaaatttagtagctgtttcaggctttaatgtgtcaagcctaaaatccagatttttgaggatcttctccctcttaaaagagtattcagttaactgccgtagaaatacacatgtatacaagggcactgtatacatcagtctaaaaaataaaaatatgtatacgttctggtgagtctagcacagcattgcccaatagaaatacaatggaggtcacaaatgtgacccatatagttaattgtaaattttctaatagccacattaaaaagaaaacagcacaaataaacaaatgagaaaatctatttaactcaatatattcaaaatatttcatcatgcaatcaatataaaaaatttctttttgttggtcatgatggcctgcgcctgtaatcctagctacttgtgaggctgaggcaagaggattgcttgaggctaggagtttgtgactagatgggcaatatagtaagatgtcatcttttaaaaatgaaaaaattagctggccactgtggcacacgcctgtagtcccagctacttgggaagctgaggtaggaggattgcttgagcccaggagttcaaggctgcagtgagctatgattgtgcttatgaatagccactgcactccagtctgggcaatagtgagtcggtcaaattccatttccccctccgccccatacctcttcaaatgtttaaaaaaaaa

SEQ ID NO: 44912 - DNA, 650 bp, Homo sapiens
  misc_feature (622)..(622): n is a, c, g, or t
  misc_feature (633)..(633): n is a, c, g, or t
gatttttggaaactaaaaatacaaaaaattacctgggcaacaagagtgaaactccatcgcaaaaaaaaaaaagaaggggcataatttgtggatgaggattggatataaggtaaaggatgggacattcttggacttacagatggtgtgattgcctggctagaagaagaattcccggtcaaaaagaaaccatcagctttccaagtgtgaaagagagataaatctgtgaagattatagggactacaggaaacttaatctttttctttgaaaaagcaattgtagcaaaaaaaaagaaaatttcttactgtcatctaaaattgacatggacatcttagtggactagaagttaagggcataaattctcccagtgatttttaattttagcattgtgattaacaccttctaaaattgccagaacttaataaataattgcttttcattattagtatgccatcaaatttagtagctgtttcaggctttaatgtgtcaagcctaaaatccagatttttgaggatcttctccctcttaaaagagtattcagttaactgccgtagaaatacacatgtatacaagggcactgtatacatcagtctaaaaaatagaggtacaaatgtgcccatatangtaatgaaatntctatagcacataaaca

SEQ ID NO: 44913 - DNA, 413 bp, Homo sapiens
accaatagggtgaaaccccgtctctactaaaaatacaaaaaattagctggacacgatggtgggtgcctataatcccagctactcgggaggctgagacaggagaatcagttgacctgggagttggtggttgcagtgagctgagatcacaccattgcattccagcctgggcaacaagagtgaaactccatcgcaaaaaaaaaaaagaaggggcataatttgtggatgaggattggatataaggtaaaggatgggacattcttggacttacagatggtgtgattgcctggctagaagaagaattcccggtcaaaaagaaaccatcagctttccaagtgtgaaagagagataaatctgtgaagattatagggactacaggaaacttaatctttttctttgaaaaagcaattgtagca

SEQ ID NO: 44914 - DNA, 241 bp, Homo sapiens
atagctgtatttttaaaaacagcattcatctcacagcactaataaaaatctatttcaggtacatttagatttccaaatgtgaagaacaaaacaatgcttctaaataattgtataagacaccattttaaagaccttgaaatgggaaatctcttaaagaggatacgaaagtaattaatgatagaagaaaatattttcaaattttagttaaaaataagaaattcaccttagaaaatataagatg

SEQ ID NO: 44915 - DNA, 652 bp, Homo sapiens
tctgctgtttctctggcatattgtttcacaatttttctttgctgatgttgcaaaggttccctgtttgtttaatttgcttaatgaagagactcatatgcaggatggttaaggtggtaccttgggggtagtagctgggactttgaagtttgcgttaggaggtatatcttaatagagcagggggattctcttttccacaaaacgggatataatgtttagaaggtttcagacttaacggccttgaaagatgacgctttgtggaggggaacgctacacactggggcctgtggggaggatggcgggagggagagcatcaggaagaagagctgatggatgctgggcttaacccggggagatgggttgagctgtgcagcaaaccaccatgatacgtttacctgtgtcacaaacctgcacatcctgcacatgtaccctgtaacttaaggttgaagggggaaaaaaaaaagaaacatgatgctttggttcttttaagaacaggtgaggaataggaatcaagtggtttcactgtttgttgtttgatggacctagaggtttaaagctgataatttcttcagactgatgtgctcagggtttttatgtaaaggtggacaaaatttggaacaaatttgaaacatcaaaggctcaaaaactagataca

SEQ ID NO: 44916 - DNA, 608 bp, Homo sapiens
ggctcttctgaatcttagaatcttattgttgaagctttggtccgtctagagattttaatcttagagacatacactagatgtgcagtattaggcatatagactaaataaataaaacataaaagcacataaaagaatagtaatatttaaaatgcataatacagatcaaatataggtaaagggtaaatatgtcaattatatttatgcatcctttttatttgatttatatattttttaaatcttagacctttattgtttctagtggcccactaaagtaagtcaggggcagaggttaacaactgaatttgctcttcagtaatattatataacaacctgagagccctaaatgaattcttatgattctcctaagtacctgctacttaatataaaaagataacttcacccaggacacttggatttatatttctcccttgaacatcatcatatatcaaggacaaggtgagattgttcttattgggcaggaaagaaaaaaactacctccataaagtgttccattttctttcttaatattaaatctaataactaggaaatgttgggcagatagaatgaaagtcgaagagttaagggcattgagaacacacaaaaaaaaa

SEQ ID NO: 44917 - DNA, 475 bp, Homo sapiens
attgttgaaaatacatttatttggagaagtccaaagccaaggggctcatggggctgtgaggtccttcttgctgcatcgtcctgtggtagaaggtggaggagtcaagagagtgccccagagtgagtgagagcgagaactagaaaaacgggaagagggaaacagaggagagagagagagaggacccatcagtgtcaggagcccactcccaagatagtggcattaataaagatcctgcgtctcactattgttgcattggggatgaagtttccaacaaaggaactttgggggacacatccaaaccataacataggatttaaataattttacagagttcaagagttctgctactgaaccgtttgagatccctgttctgaggtctcatcactttccagttttagcaggaagagaagtggcaagtggcaggagtctgcagattggggcctgcacctttttttgaggcaccttttttatgaac

SEQ ID NO: 44918 - DNA, 421 bp, Homo sapiens
attgttgaaaatacatttatttggagaagtccaaagccaaggggctcatggggctgtgaggtccttcttgctgcatcgtcctgtggtagaaggtggaggagtcaagagagtgccccagagtgagtgagagcgagaactagagagcccactcccaagatagtggcattaataaagatcctgcgtctcactattgttgcattggggatgaagtttccaacaaaggaactttgggggacacatccaaaccataacataggatttaaataattttacagagttcaagagttctgctactgaaccgtttgagatccctgttctgaggtctcatcactttccagttttagcaggaagagaagtggcaagtggcaggagtctgcagattggggcctgcacctttttttgaggcaccttttttatgaac

SEQ ID NO: 44919 - DNA, 2267 bp, Homo sapiens
  misc_feature (697)..(697): n is a, c, g, or t
  misc_feature (766)..(766): n is a, c, g, or t
  misc_feature (944)..(944): n is a, c, g, or t
aattgatggcatcttaatcttggtgtcagccaagcagtagttgtaacacagtcttcattgcttgtgctgtgcatcatatgtcttgcagttaacccatagggattaagtggtagtgtttagggggtgtggcaggaggtgagtttaacataaacctccaagcaggagtcaaaagtagacaagctctatataattacacccctgacttaagaatctagcatcaagtagcttttgtttcttttatggatagttttaagaaacgctgcatcaccaactcccttgatggcactgaaccttttgtgggaaaaccagacaatgacactgaaattaaaagtgattcaccagagtcagactctgaaagtgaagaactatcagaactaactactttatttcacttatattttccttttttgaatgctcaagtgttgtatgatctcatttaaagtgcttctaataaatatataaaatttataagtgaccaagcgttatgttagttaaacagaagtatttttcttagtatggggaaaaaatggctatacaatctggccagacgtggtggctcagtctataatcccagcactttgggaggccgaggcgggcggatcacgaggtcaggagatcgagaccatcctggctaacacggtgaaaccctgtctctactaaaaaatacaaaaaatacagaaaaaattagctgggcatngtggcaggcacctgtagtcccaggtactcgggaggctgaggtaggagagtggtgtgatcccaggaggcngaggttgcagtgagccgagatcacgccactgcactccagtaaaacagaagtatttttcttagtatggggaaaaaatgactatacaatctgatgtcttggattcagcaaaatatggtacttggccaagcgcggtggttcatgcctgtaatccctgcactttgggaggctgaagtgggcngatcacatgagctcaaaagttggagaacagcctggacaacacagtgaaaccctgtctctacaaaaataataatacaaaaattaactgggtgtggtcgcatgcacttgtagtcccagctacttgggaggctgtggtgggaggatcacctgagccccaggagattgaggctatggtgagccgtgatggcaccactgcactccattgttggcaatatatcaagactctgtctcaaaaaaaatgtgtgtgcagttggtcggggtaggggggtggtatttgtgacaaaggctgtttattagaaatcaatagttttattggtaaaattcatcatacttttccattaaaatcagatataggatataggtacttatacacattatttttgaaggttctagtttgctaacacaaaaagatgatagttgggttgaaccttattcaggttggacacctctaatttgagtatctgaaatgctctaaaatctaactttttgagcaccgactcaacactcaaaggaaatgtttattttaagcattttggatttcagattttgggattagagatgccaaattggtaagtataatgcagattttctaaaattccaaaaaatccaaaatgcttctggtcccatgcatttcagataagggatgctcatcctgtagttgtatacctaggaaaggagattctaagttttttaaaaataccagaatttaaaagttggtaaggttgatatattcaagataatatagataaaaattatcttcgtactaacactaaccgctttgacatgcaaatagagtaaaataacctcttgtcattataacagaaccacagtttgaggaacaaatttaataataaactttgagaaataaatttaataatctttttgaagaaaactaatttttttttcaatcctgtcttatggggttgaaggaagacttaatttcttcttgaaagacagaaccgtgatattcaacgtaatggcataatgtttctgggtataaaaagtcttaatataggtcaggcacggtggctcacgcctataatcctaacactttgggaggctgaggcaggcagatcatctgagttcaggagttcaagaccagactggccaaaatggtgaaaccctgtctctaatttaaaaaaaaaagccaggtgtagtggcacacgcctgtagtcccagctactcggggcggggctaaggtaggagaattgcttgaaaccaggaggtggtggttgcagtgagccaagattgtgccattgcactccagcctgggcgacaaggctggagcctgggcgaaactccatctcaaaaaaaaaaaaaatct

SEQ ID NO: 44920 - DNA, 948 bp, Homo sapiens
gcggccgcccccgcaacccctcagccggtctggatgccgcctgcagggtatgtctgcagtctctgcccacccaccactgggtggaaagggcaaagggcgttccccctgctccacactgagtccgcctcataaagatctcattgtgtgattctcaatagcaggctctgtttaatggcaataatattatcttctgctgctgacatgccatctccttttttaaaccgagaatatttggctgtgttttcctctacatgcggcgccatttcagacagaaaggagtctccagggcctgtgacctgggaaacgcagagccagcagggaggcaggcgaggatttacccgtgagccaggtgacatggtgacatggtctggagaaggccagaaagccaggagggtggagtgcccaggggcgggggtggcggggagttgggaggaagagggagatttttgtaccaattcacttcaattttttatttcagcaagcagcagtgggcctgtgaagttttcaaagtgccccaggcatttctttctggactcaatatattaagtcaaagaaagtagcaggtcttaggtgccaatgaagtggcattaagctatttctctttgcaaggcctccttctctgtgaagcaaatcccagccactcactcacttaaagcaatgcagaacgtctggtcagcaaacagaaaaaggataaaaattcctcagttcctcacctgtattattaccattccctcccccagggaaaggcaggctagtagaaattctacagaggtcagtaaacataggtggttatttgcaaaagtagttagtacttttctcaggctataaaagcaatggcatttgggggtcacaatgctaaccatacactgccccctctgatgacttttattccttgaggttcgctcattggatgccccactctatagccagatcgcatcacacagcctc

SEQ ID NO: 44921 - DNA, 626 bp, Homo sapiens
ccatgttgttttcaaggttttctccgtctttcaacttcacagggtcgatttcacagggtttgtgggctttctgcggagggcgatctgcctgccttagcctcccaaagtgctgggattacaggtgtgagccactgcacctggcggaagttcttaactttaatgtaatccagtttatcagaattttccttcatggttagtctcttttggagttgttgttgttgtgtttttttaaatttaatttatttatttatttatttatttatttgagacagtgtctcattttgttgcccaggctggagtgcaacctgggctcacagctcactcatcttactgcagcctcatcctcccaggcttaagcaatcctcctacttcagcctcccgagtagctggggctgtaggtgtatgccaccatacctggctagttttgtattttttgtagagataggggtcttgctttgttgcccatgctcatctcaatctcctggcctcaactgatcctcctgcctgggcctctcaaagtgctgggattataggcatgagccaacgtgcctggcccgttagcccttttgtaacttaagaaatgttttgactattacaaggccatgaatatagtctttcatttttat

SEQ ID NO: 44922 - DNA, 262 bp, Homo sapiens
gtaacaggaagaaacacagttaaaatcccttcctttatggaatttgaactgtagatttggagactctgtttttgaacctgtaagttacagtacaacttcagatagtaacaagtgtcaagaataaaataagctggggaaagagagttatagagttagagttgtcagggaaggtctctcttgatgtacaaaaagctgtgcacgttttatgtatacaactccatccatttggagataagtgtacacccattgtattagtccattc

SEQ ID NO: 44923 - DNA, 149 bp, Homo sapiens
tcgtgttcctaatttaaaatttattagaatattcttaacccttcttcagatttaaattaggattttaaaaagaaagtttaggatttaaaaagaaaattaggattttaaaaagaaagttttacgcaccaccaagtccagacgccagccga

SEQ ID NO: 44924 - DNA, 497 bp, Homo sapiens
tttgaggaaataattgtcaaaattttccagatttgttgaaagatataaatttataaattcaagaagtttcatgaattccaaatggaataatctcaaagaaaaccacctctaggcacatcttattgaactgctgaaaatgaaaagtaaagaaaaaattttggactgatcattccaagatggccaaataggaacagctccggtctacagcttccagtgtgatcgttgcagaagacgggtgatttctgcatttccaactgagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtat

SEQ ID NO: 44925 - DNA, 503 bp, Homo sapiens
ttgccatgttttgatgccctcaaaagaagttgtcggatgtgactgcccagtcttgaacttcccagccctcaaaactaacagaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaaattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtat

SEQ ID NO: 44926 - DNA, 650 bp, Homo sapiens
ttgccatgttttgatgccctcaaaagaagttgtcggatgtgactgcccagtcttgaacttcccagccctcaaaactaacagaacatatcttccagtagcttcctgagaaagtgtatatgcaaagcacacttctgagatctttcagatggttttgccacattgcccaggatggccttgaactcctgggctcaagtgatccacttgccttggccccccaaagtgctgggattacaggttgctatgaaaagaaaaatcatgatattaagcacatcttattgaactgctgaaaatgaaaagtaaagaaaaaattttggactgatcattccaagatggccaaataggaacagctccggtctacagcttccagtgtgatcgttgcagaagacgggtgatttctgcatttccaactgagattttagcatcgatattatggaagctatgcctggactcaacaacacgaacttctactcaccaaggctgatcttgtactaatactaagtgcccaacctgacaacagagaagatgatgagcctttataagacaccattccttaggggcatcagccagtcccatggtgttaggattattacatgggacacctttcatcatcatgaaaacagaaacttttcctcatggaaatgaatatgtat

SEQ ID NO: 44927 - DNA, 443 bp, Homo sapiens
acctaacctggtgactttttgttaacaactttatttaagatacaattaacatgtaatacactgcacatacttaaaactttggtaactcttgacacagatatacaacctggaaaccattacccaaatcaatataatgaccataaacatcatactaaagtctgcacaggcctcttataaacccctctctcctttccacccctctctgctctctgcccccaagtctccaggaaaccactgagactttctgtcactatgaattagtctgcatttttaaaaatttcacataaatgggtcatacacatatatgtattttttacctggcttttttttttttctcactaaactttgttttaatgggtctcaaaattctgcgacagaatttcggtcaagttgtttccattaaaacgtactgatttaaaaaactagtaaaactaccacatgca

SEQ ID NO: 44928 - DNA, 929 bp, Homo sapiens
ctgatgctgaggctctcatgaatgcctcaagacacagccaggcaggcaagcaaagggaagagcaagtgacactctaacttcaatttttgtctgcagccatgaaatgagaattctctttgcaagatctttatgaggcttgtagtgtgtgttttcatggtgcaatttgaatgtgttttctaaaaagttagcaattagctgtaattctgtttgtaatagaaaaacttgtttgcattcggcctcagtacatagtgacttgcggtgcctctgtgatcgatagcaggattactctttaaagggcttagtatattctgctaatgtttatttgaaagacattacagtgatgctttataaatggattttagtcaacatatgaatggggtatttttctagaagacagcttgcatgcaaacaaactagcaacttaagctaacttcccctgactgacagttttgaaatgtgttgtaggaaaaaaaaatggtacatgaatgtttccagacatcaaattagttatataaatgcactttgaatgggaagcaagctttctggttaataaacacagtccatgctattctaccactggctgtgtcttagaaggcctcagaggccactccaaaaacaatgctctgtgcttttataatattttaatgtccctggttatatcagtaagcatacattagaaagtattagcttaaaacattctacaccaaaatgaagtacattcacatattttgtgctgcatcttacaggtcttctagtaccttctatccccttctatgattggtcgtacacatagtacgtaagagcctcttcccatatagaagaagggggaaagctaagctgctttcagctatcaacccaggactggacccagtgcctggctcataaataggccctcagttaataaatgtataatattcctttttgaaaaa

SEQ ID NO: 44929 - DNA, 530 bp, Homo sapiens
atctgtaatcagttaacaaatctggttgtcctatttaaggtaatccttttgccgggtgcagtggctcatgcctataatcccagcactttgggaggcccaggcaggaggattacttaggccaggagtttgtgaccagcctgggcaatatagcaagacttcatctctaataaataaattaaaaaaatcctccctccttatgatgcaggccaaattttatttaagaggtagtgtttcagtaaaaaaaatgtcaaaggaggagtgaggtatgcccatttttagagtcatcaatttatagagctttggtgttctctagatctttgatgtgacttaggccgttgttcttaagaataagatccaaaggccataggtctgaatcacctgtgatatctattaaatatggagaggcctggaccccgaccctgactactaaatcagactcagtagggcaggagttctcaacccaagtctgcaccttagaatctcataaggggacttttagaaaataccaatggcagcaaggcgtggtggct

SEQ ID NO: 44930 - DNA, 316 bp, Homo sapiens
ggatcttatggtgaataatccctgtaaaagatgtttcataattaggaaacttttatatcactagtgtgttgacaaactggttgtcacactctgtttaggtaacatttattgttcctacatttgttcatctacttattcaaaaaatatttattaggcatctattctaaattctggcagtattttcttcttgcatggttttggaaagtaggcgttgttacctcaggagaatcgcttgaattggggaagcagaagttgcagtgagccgagactgcaccactgcactctaacctgggcaacaaagtgagactccatctca

SEQ ID NO: 44931 - DNA, 535 bp, Homo sapiens
agaggatggccatgggtgtctcttcttcccaaaggggtgggtggttcaagggcaggtagctgatgctaagttggttctccctacaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaagg

SEQ ID NO: 44932 - DNA, 922 bp, Homo sapiens
tgcccagccctgttccgctcaggcagagtcctgcccctgcacccactcccccattcccggccccaggccatgccccaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaagg

SEQ ID NO: 44933 - DNA, 1124 bp, Homo sapiens
gtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaagg

SEQ ID NO: 44934 - DNA, 1175 bp, Homo sapiens
gtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaagg

SEQ ID NO: 44935 - DNA, 1754 bp, Homo sapiens
  misc_feature (254)..(254): n is a, c, g, or t
gtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacangggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggcaagttccaggtggacacaggtgccaaattctaccgtggaatgtccctggagtactatggcatcgaggcggacgacaaccccttcttcgacctcagtgtctactttctgcctgttgctcgatacatccgagctgccctcagtgttccccaaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaagg

SEQ ID NO: 44936 - DNA, 1601 bp, Homo sapiens
  misc_feature (254)..(254): n is a, c, g, or t
gtgaccacagaggcagaggggtgggcgggctggcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcggccacggcaaacaaccgctttgagctgtggaagctgggcatcacccacgtgctgaacgccgcccacangggcctctactgtcagggcggccctgacttctacggcagcagtgtgagctacctgggggtgccagcccacgacctccctgattttgacatcagtgcctacttctcctctgcggctgacttcatccaccgtgccctcaacacgcctggggccaaggtcctggtgcactgtgtggtgggcgtgagccgctctgccacgctggtcctggcctacctcatgctgcaccagcggctgtccctgcgccaggcggtgatcaccgtgaggcagcaccgatgggtcttccccaaccgaggcttcctgcaccagctctgcaggctggaccagcaactgcggggtgccggccagagctgaggggccagagctggtccttactccctgccatggggctctgccactttgccaccctggcactgatcctgctggtgctgctggaggctctggcccaggcggacacacagaagatggtggaagcccagcgtggggtcggccctagagcctgctactccatctggctcctcctggcgcctacaccccctctcagccactgtcttcagtctccacagaaacagcatcaagtgtgcggagacaggcggctgaaagccggcagcacgaactgcccgtcagagaagtgcacagcctgggccagatactcccacaggatggactcactgcagaagcaggacctccggaggcccaagatccatggggcagtccaggcatctccctaccagccgcccacattggcttcgctgcagcgcttgctgtgggtccgtcaggctgccacactgaaccatatcgatgaggtctggcccagcctcttcctgggagatgcgtacgcagcccgggacaagagcaagctgatccagctgggaatcacccacgttgtgaatgccgctgcaggccgcgtgctggtacactgtgccatgggggtaagccgctctgccacacttgtcctggccttcctcatgatctatgagaacatgacgctggtagaggccatccagacggtgcaggcccaccgcaatatctgccctaactcaggcttcctccggcagctccaggttctggacaaccgactggggcgggagacggggcggttctgatctggcaggcagccaggatccctgacccttggcccaaccccaccagcctggccctgggaacagcaggctctgctgtttctagtgaccctgagatgtaaacagcaagtgggggctgaggcagaggcagggatagctgggtggtgacctcttagcgggtggatttccctgacccaattcagagattctttatgcaaaagtgagttcagtccatctctataataaaatattcatcgtcataaagaaagg

SEQ ID NO: 44937 - DNA, 364 bp, Homo sapiens
gctgggggtagaattctaacgttggcagtgattttctttcagtatttgaaagatataatgctttgtattctgcattccactgttgctattgagaagtcagctgtgaaccttatggttgtccctttgagagtattttgatgatagtctctcttttctctgacttcttttaacattttatcttttgttaagttttagatgtactatggcatggctaagagtggattatgcatattccacatgtatatatatttgcatatgtgtaggcgtatgtgtgtatatttgtgtgtgtgtgcgtgtgtgcatgtgtgtgtgtgtgtatatatatatatatatctaaaatcactctaattcaatttcaggggct

SEQ ID NO: 44938 - DNA, 617 bp, Homo sapiens
ccagaagctgtggtacagaactgtccattcccattatctactttcccatgtgaatccaattctgtttaagcatgtgtctttcagcgatgatgcctaaagccattcactaaatttagatctctgaagtctgttactaaagaccccattttgctaatatctctgattgttatactgtttattattgagaattttaggcctatagccatccatttgtttgtgggcgcatgtgtgtttttctaatatcttcttacgcagtgtgttggtgtaattattgctcactgtagccttgaactcttggacacagtggtcctcctgccttagcttcctgggtagctgcgactacaggtgtgcagcaccacacctagctaattaattttttttggtagaaacaggatctcactatgttgtccagtctggtctcaaactcctgggctcaagccatcgtcttggctcagcctcccaaagtgctcggattaaccttgtggttttatcctaaacagcaataaatgaatggtattctaattctctgtgaagctaacttggctaggttgtctttgcctgagcttcttaacttgtccacataaataaatcactataatctggggttaactgagtat

SEQ ID NO: 44939 - DNA, 449 bp, Homo sapiens
ccagaagctgtggtacagaactgtccattcccattatctactttcccatgtgaatccaattctgtttaagcatgtgtctttcagcgatgatgcctaaagccattcactaaatttagatctctgaagtctgttactaaagaccccattttgctaatatctctgggtatgccattactctaggagcaattgagattgagacatattttagttctctgctgtcaaatgtaagcctccaggtactgttcagctggagtttgcaggctgtagggctgttcacgtccattattgctttatgaggtgttctctgttgtttacagtttgtagaggctcatttaggaactctgtctatatgtccaggccagtcaaagccagatatctgtaactttaatttcatgtggaattcattctcaggcttcctagggctttaatttcatggacacagaagccac

SEQ ID NO: 44940 - DNA, 489 bp, Homo sapiens
tgaggttgccagcctccaaggtggccccagcaatcctcacattccaggtcatgcccttgtgtagtctcctcccacagtcaatcaggctggtctgtgtggccagtgaagtgtggcaggggtgacagtgtgacttctgaggctgggtcacagaggcatcatggcttcagcctttgcatcttcagatagcttgttctggggcgaatcagctactatattgtaaggatgctcaacctgccttgcagagagccctgtgtggagaggaactaggcccccagccaacaaccagcagtgactcactgtgagagagtgaatcatcttggaagtggatcctaagccccaatagagacttcagatgaaactgcaaccctggctgacatctgactgcagtggcataagaaacccttatgtcagaatcaccctgcaaagcccaaattcttgacccaccaagtgaaagagaataaatgacgattgttgtgtttgaaaaaccat

SEQ ID NO: 44941 - DNA, 375 bp, Homo sapiens
cttgaccccagccccttttgggaaaggcccaacccagagctggatcacaaggaagactggaagctccactcccccatggagcttccctgttaccagaggacacaaacacacatctgcatgttgatctgagagccctgtgtggagaggaactaggcccccagccaacaaccagcagtgactcactgtgagagagtgaatcatcttggaagtggatcctaagccccaatagagacttcagatgaaactgcaaccctggctgacatctgactgcagtggcataagaaacccttatgtcagaatcaccctgcaaagcccaaattcttgacccaccaagtgaaagagaataaatgacgattgttgtgtttgaaaaaccat

SEQ ID NO: 44942 - DNA, 609 bp, Homo sapiens
tgcccgtcttgggcccgcccttccgggccctgccgcgttgagtggcggagtcgggatccaggtggcccgccggccggctcagtccacctcctcgctcccggcctcgcgccccaccccttggatgagaaaactgaaactgagaggggacgtgactgatccaaggcctggcatttccagctccggagcccgccacaagaagctcctagccccacatgatgtgaatgcactgggccccagccaggaagtggagacccgtgaaggcccaacccagagctggatcacaaggaagactggaagctccactcccccatggagcttccctgttaccagaggacacaaacacacatctgcatgttgatctgagagccctgtgtggagaggaactaggcccccagccaacaaccagcagtgactcactgtgagagagtgaatcatcttggaagtggatcctaagccccaatagagacttcagatgaaactgcaaccctggctgacatctgactgcagtggcataagaaacccttatgtcagaatcaccctgcaaagcccaaattcttgacccaccaagtgaaagagaataaatgacgattgttgtgtttgaaaaaccat

SEQ ID NO: 44943 - DNA, 524 bp, Homo sapiens
tgatcagtttttccattcatattgatttctaattttcatttattcactcatttaacacgtatctgttaagcagttaacatgcgccaggtactgtgctagatgctagggatcagttgtgaccaggaatagacatggtcccttccctcatggagtgtagcttaccatccagtggtcagggagactcagtaatacagtgcaaatcatgcagagctactactgaaaaatgctgtgacggtcataaacataaatcaaatggagccccactttagtatattgtatatagtacagacatttaccagtgatgtaggctatactatggtgcatacaataatagtacaaaaacagatcacagaaagcatagaggaggcagggacaattgtggaaaggggaaaggatggataagggcctcacagagaaaagaaactatcaggactcttgggtgcaggtaacaaaatataattaaaactgattctaaatgggatgtattggcctatataattaaaaacccaagagcttaaataata

SEQ ID NO: 44944 - DNA, 220 bp, Homo sapiens
gaagccaaataattcttttcttccccaaagaattacagaggacctactgcatcctgatcccaaggctacgaaggggaatacaatgtggctgactgagtcattctttcatgtattccttcaacaaagatatattgtggtctcctaattcctactacatccaagtgctaagctagacaccaggcacatggttataaaaaataaagtcatgtggccaggcaca

SEQ ID NO: 44945 - DNA, 368 bp, Homo sapiens
ttcatttattatgctggcttgctttttatttaacaaaaggggaagggaaagggaaaggccaggaaaggaaaagagaaaaacaatggacagccaccagacagtctcttgcctccacagtgttaggatggaataaacccacagactcaaggtcttccctactccagcctcagattacgctccactctcctccccagctgcagcctctgggaccatctctttgcccatccccttcttctcaggccagcgaacaatggtttttttctccaaccatgagctcccaaatctaccagaattattccactgaggtcaaggctgctgccagctgcttggtccacctgcatctgcaggcctcctctatttatctctct

SEQ ID NO: 44946 - DNA, 268 bp, Homo sapiens
aaagaatgtaaatgcaaagatgaggaaaatcaaaggataataaaggactggaggagaaaggtaggatatgcactcatgagcacacatgcagaggttcatcttagaaaaggggaaggcattcttactgcaaggcagatatgcagggaaagagaaagaataaaagcagaggtagagagagacaccagaaaaaattctgaaaacctcatgcccaaatgtcctcaagctcagttaaataagaaaccaagttatctgctgagagcaagaatga

SEQ ID NO: 44947 - DNA, 150 bp, Homo sapiens
cagctgttcttttaatgaatcccccaaacaatgaaagtttactactgtaagaaatgtgtttctaagttctgatttgtgtcttgtacttattgttcacttggttgctatgaaattctgtagaacatataaccatgctttaattccagggct

SEQ ID NO: 44948 - DNA, 515 bp, Homo sapiens
cctcccatcctgcctctgctgtaacactggggattacagttcaagatgagatttgggcagggatgaaaatccaaatgagatttgggcagggacacaaatccaaaccgtatcaggcacctttacccaagcttcctctcttttcctgatctctgctatttaccctcccagctttctgccccaagttgtccatgtgtcagaaattaatacacctggaagtattgctggcagtaagcacccggaatctcatgcctgaagcatgggagaaagagacaacccagggtcttaaaaccgagctcacgctgtgttcactaagcagcacaccctggtctggggttcatatttgcctagagaaggggccgtgttttttttcactctccaaattctgcactgaaagagggtgaagttggggagtaaattaaattaaaggcatgctttaagttcttgaaggccctaagttaatgaagagggaactgcaactgttggaaaaaatcaggacctttctaatttgtggcagt

SEQ ID NO: 44949 - DNA, 311 bp, Homo sapiens
ggaaatgactaccagggtcctggaggcctgctggattacattgatagattatttcagatttcctgagtggagagtgcatgtgcaaagtgccagagggtggactggtccccaaatctctctactggaccatggaggagctggagaatgaagacctcaagctctggactgagaccatctaccactctgcaagcatcttcaaaggagccccacacaagattctcattcagattgtggatgcctcttcagtcaccacttggaattttgacatgtacaaaggggacattgtctttaacatctatcactccaagagg

SEQ ID NO: 44950 - DNA, 404 bp, Homo sapiens
tgtgcgtgggatgataacagcttaccaaggtcagccctacagcaagaggggaagacaatacgaactctgcccgacagctgctaaggaatgccaagatgttcccctggaagtctggtccctgctggaattctcctgggattcctcagcaccctatctggagttcaccgttcactttcttttctctagaaagccaagctacttctcgatgtggggaaagcaaggagcttctttttcttgcattttgttgtaaaagacaaggacatcctagttacaccattttttcctgagcgttccggggaaggctggcaggctgtgtctaacagagctgctaccccaaaatgacatcctccaaaggtcagagccaaatactaagtgcttcaattaaatgcgaacattccttttct

SEQ ID NO: 44951 - DNA, 96 bp, Homo sapiens
aactttttgagtgccgacatgactctcaaaaaacatgctcattggagcattttggatttcagatttgggatgctcagccagtaatgcaaatattcc

SEQ ID NO: 44952 - DNA, 430 bp, Homo sapiens
ttcccagggggacattgtatgtaggtaacagagataagaccctgtgagtcaggagactgatcctactcatgactttgttcctggttgtctgtgcaaccttcaatagctacttaatctttctgaagttcagtttccccattggaaaaattaaggctaggcacaatggctcacacctgtaattacagcactttgagaggttgaaggaggtgggtcagttgaccccaggagttcaagaccggcctgggcaacaaagtgagaccccccatctctacaaaaaaaatttaaaaattaggcacagtggaatgcacctgtagtcccagctacttgggaaaatcaggaagatcattcgagcccaggagttcaaggctgcagtgagctatggtcgtgccattgcattccagcctgggtgtcagagcaagattctgtctca

SEQ ID NO: 44953 - DNA, 652 bp, Homo sapiens
gtctttctttataaggtgacagaaatggccaccagaatcatattaagcttggaaaaagggaggtactttttcccagtcagccctaagtatttccagagttaattttcactgggctgccttgtgtcagatgcctactgagggagtgggaagggtaggtctaataggaaatcttggtaacagtatatgttaccattaaagggaagcctggattccaggaagatcaaaacaacaggtagggctcttgcctgtccaacgcttaacaatacactttgtgttggcacagtgagctttgcacatgaagttagttaaaaataaaatccatagttaactgataaacctttgttccagccaatgaccttgccttaccccaagaaatattatttattaaatattatgaaattaaatgaaaacagttatgagctcttatgataaagcgtagagacaacccaatttcaagttaattcacaggaagataataggacaatatatggttgtttatgatcttgtttttacactgcttcatattttacatatgtgactttcaaaatcttaagacttgactggtctcgaactcctgacctcaggtgatctacccttcttggcctcccaaagtgttgggattacagcgtgagccaccgtcccagccccactt

SEQ ID NO: 44954 - DNA, 309 bp, Homo sapiens
gccaatgaccttgccttaccccaagaaatattatttattaaatattatgaaattaaatgaaaacagttatgagctcttatgataaagcgtagagacaacccaatttcaagttaattcacaggaagataataggacaatatatggttgtttatgatcttgtttttacactgcttcatattttacatatgtgactttcaaaatcttaagacttgactgggcacagtggctcacacctgtaatcctagcactttaggaggccaaggcgggaggatcacttgagcccaggagtttgagaccagcctgggcaac

SEQ ID NO: 44955 - DNA, 1291 bp, Homo sapiens
catgttatataaacttggtacttatctcaaggctgtctagtctcttaatgctgtgacccttgaaaacctagagaatttaatgtctccagttgggctgaatttaggtttaggtttggtagaataatgggaagggtaaatcttcagagacacttgactgagtcctcagagacacttgacgaacttgggaaaggaaagaagaataggaacaactgggcatggtcagtgataccctgagcaatcacattacttcgctagatcctgcactttttctctgaacaaaaagtagttcaagaattatttcctgagttgatcaaaaagacttatagtcatatggttaattatgtgttgagcatgtctttttattatttttgtaacagacaaaaaatattaccatataatttaagaaaagaaggtactttccatatctcctgagttggagatacttctgaaaggagcagaagagatgggagaaatgtacagttctactttattcctgaagtcctggttttaccagataaaattaagtgagaggaaaattaaactttcttgtccgattgtttttttctaccaagttatagactttaaattttggcaggataaaaataaaatgtgagacagatttactttttggctcacataacttcaaataagacgacttaaaaatggtttggagcattagtattttgactgtagaaaaaaattattcatttagtattaaaaaaaaaaaaaaaaaaaaaaaaaaaaatttggggggggcctctgggcccttgagaaaaacgttttctaaacaccatccggtggggcgcgcgggggccccagagggtagggcgacatgggccaaaagcgggtcccaaagggaaacccgggggcagagcaagggcggggttcctcacccattaaaaaaagggcgggggggggaaacaccgagggtgtctcctgaaccaattctccgcagagaggagtccagagaggccacaaaggggcagcactacacacacgagcgggtctcccaagggaagagcgcgaaattaaaatagcagccccgggggtgtgctggcgcagaagagaagaaaacaaaaacaagcaaaaagaaaaaaaaaaccaaaaaagaagctgaaaccagggaggagagaagacaagtggtagacatgcgacacacagagccaaaagatcacaaagcgaacaaagacacacagcagacaggagacagaagacgagagaaacgagaaaagagcagaagggaagaacggaagagaaaaacacgacagaaaaagacaacaacgaaatcaaa

SEQ ID NO: 44956 - DNA, 461 bp, Homo sapiens
gcgccatctcagctcactgcaagatccaactcccaggttcacactattcttctgcctcagcctcctgagtagctgggactacaggcgcctgccaccacgcccggctaatttttttgtattttagtatagacagggtttcaccatattagtcaggatggtctccatctcctgacctcatgatccacctgtctcgacctcccaaagtgctgggattacaggcgtgagccaccgcgcccagccataaaatggattttttaaaaagcatctgaatctgtttaacaaacttgaaataaagtagggacacagggctgcccctatggttgtacagattgtagtctctgagagggggacctgagaacggacaagaattgggctgaaataaagctcaggagccatttgccaagccctgtgacttcactcacagttgcaagagcctggaggaagtagcaactttttctaat

SEQ ID NO: 44957 - DNA, 163 bp, Homo sapiens
ctgtgggcggcctgccggttctctaaaggctctgtcagtctgtctgtctgactgtggggcctgccggcgctctaaaggctctgtctgtctgtctgactgtgggacctgccggcgctctaaaggctctgtcgcaccttgtcttgaattaaggatccgctgcaga

SEQ ID NO: 44958 - DNA, 742 bp, Homo sapiens
ttagagatgggggtcttcctgtgttgcccaggctggactcaaactccttggctcaagcgatcctcccaccttggcctcccagtgtgctgagattacaggcgtgagccaccgccccagcctcctgtttacatttgttacaggctagacccactcggatctagcggaggaagcgggtgtgccagtctcggatgcgaacccctggttgtccgcagggtttactcgggccaaacttcagaatcattgagaatcagtgcatgagcttgctcaaaaatggccgattcctggacccatttcacaaggagcatgactcggtgagattcgggtaggagccaggaagcgtgttgttgctgccattccctctcaggggactgtggtgcggggctataggactttgaagaaaccctacagaggagagcaatgggctcaggaaccaggcagggcccacctgcgggagggagggtggcccacagaggctagtacagttgctggtcagccaggccagtttcccgagtgccaggccagtgccccgtatgctcccagggacactcggcctttgccccagcccaggcctctctgtctcaggtgacactagaatcgcctctcacttccctgggctgggactccaggaccccactgtgtcctgacggtgccaacatcagccaggaaatccactcgccccaccccctgctgggtcacaatttcagacattcctccagctgagacccctgagccaaattaggca

SEQ ID NO: 44959 - DNA, 164 bp, Homo sapiens
ggagatataattcacatgccataaaattctccccttgaaggtgtacaattcggtggtcggtggtaagtatattaaggtggcaatgcacccatcaccagtgtctcattgccaaacgtcttcatcactccaacaggcctattgatggtcactccccatgctccttg

SEQ ID NO: 44960 - DNA, 409 bp, Homo sapiens
gtagagatgggccttactatgttgcccaggctggtctcaaactcctgggatcaagcagtcctccctcctaagcctcccaaagtgctgaaattacaggcataggccaccacaactggccttgaatgtgttaccttttaaacaataaatacaattttgttaaaaataattccttaagttaaatagctagagaactttaatctttttttaataaataaataaaaatagcgtgttcatcatctggatatttaattatttgctttcttagcttcttctaccacactaattggtgggttagattttatcccccatcatatgcaatgttttgtttttttttcacaaaatatgagaatgggtttcctcaaaatatgctatataacacaaacttaaaagttgaccaagaagggctcac

SEQ ID NO: 44961 - DNA, 400 bp, Homo sapiens
aaacacatgccatgggaatagccatttttttcaggattagggacaactggaatgatgttgtttagcgttaggaattcatgatctttagtcttttgtggctctgctactctctctgtgtctttgggtaacctccactaactagttgactagttctctcagtatttcttctttcaagagggaggagtctgatggagccagctactcaccccaactcctctcaggcagaactttctttccaggctacctcataggtatctcccctcctgtccccctccctccaaggccatgtcactgcccatctgtgtttaatagcctagaactcccctcagcaggggtgtaggaggggcatcgcctctggaagggggtggagaatcacagtcaatgtggccaacatttttag

SEQ ID NO: 44962 - DNA, 553 bp, Homo sapiens
ctttctaccatcatactttttccagcagtaattaatttggaaacctgctgtaaagtattttttttttccttgtgcagagcttcacagaactactcctactataggaaaggagggcttatggaaaggggtaaagattaacttgacagtagcgtacagtagattggaatggggagaattgaagaaaaggaaggcttgtacgaagaaggctgtagtagtctacatctccactactggtcaccacctccaatactggtcaccagaaattggaagaaatcagattgtcctgagaacaattaatagaacttagtatcttccttggtatagggagaacaaaggaagagacaaagataagtcaaaaagtagttgtaataatagtagtgatataaacaataagataaaaaaaaagaatggctaatgtttattgagcgtgagtatttgccaggtttagctctaagcaccttccttgtattcagcatttatcctgaggcacagagtgatgaagtaacttgcccaaggtcatacagtttttgagtagtgaactcaagattggaac

SEQ ID NO: 44963 - DNA, 442 bp, Homo sapiens
ggccttggaattgtctttcagcctccaaagccggccgttttcttacttgtagaatgggcctgcaccatagaacaattgtaaggtgtggtcatgggcatctaagagagggccatgcacgttgtaaagccctacacacgcccctgtttgtgggccctgagaagactgcccccctcccccgtgtaaaaggcctgaagaggacgcacattcagagtgacaaatcggctctttagaggaccatcaaggtgactctggcaggatgttttaggacagtgccattttgaagagaccccaagcgatgaagaaggatctgtaatttgagctctctttagaaacacatttcatccttataacttatttgcctctttttcaccctctcaaactaaatggagcatgtatgaatggctcatgtaaaataaagcttacgttgccataaaattaatct

SEQ ID NO: 44964 - DNA, 480 bp, Homo sapiens
aataaggtatctatcacctctagcatttatcctttgtattaaaaacagtgtaattatatacttttagttattttaaaatgtacaataaattgttattgactacagggttatttttatgatcataataaaaattatacagaaatataaataaaatacagccaggcccagtggctcatgcctgtaatcccaatactttgggaggacaaggcaggtggattgcctgaggtcaggagttcaagactggcctggccaacgtggtgaaacctcgtctactaaaaatacaaaatatagttgggcattgtggtgcatgtttggaggctgaggcaggagattcacttgtaactgggagctggaggttgcactgagctgagattgcaccacttcactccagcctgggcaacagactcaatctcaagaaaaaaagaaatagaaatcatacatatactgaaaacttattaataaatgtttgttatatggttt

SEQ ID NO: 44965 - DNA, 997 bp, Homo sapiens
ggccgccggcgcgaaggccccagccgaaggaagctgcgcccccgcagggccggagccgcggctactgctccgagagccacgcagagcctggccttggccttggcctcctggtgctggggctgccgccgctgcgggggttgccgctgcgccgggtgctgctggggccgaggttgaacagagacgccagctttcggtgccttcgctcccgctcacacacgttcacacccccgagggccgggggagaggcgtccgggcgatatcggtattgagattaataacaaggtgcagagagtgcgagaacgaggagggttgattgacgtggaggggctggcgggagtcagtcactccccggcgcggagggttggggtgaggggaaggaggcggggcggtgacggggcggagctcctacgcagcgccttggccccgccccccgtgcgccgcgttttgtcgcggtgagcgcgcggaggcccgggcttcttaatggttttctgttttgctctggctgttttctcactcttttttcctggcctgagcgaggagcggggctgagaagagtggtagagtttcagaaacccacatccacagagccttggcgaagagacgggaaaccgcctcaccccgggttcttgtgtgggcgctgtttactgcaccctcctcgcccgaggcgacctgacagcgaagcagagcgtaggtctaggtggctgagacgccaggggaggtgaagtgaccgaaggaaatgtttcctgacatattcggtggattttttttaaaaacatatagcatctgtaagttgtatcgtcaaaggtaaataaaagaacctgtgacgctcagcgataacccggtcctattttctaattctcccttctcgttgtagactttagtttgttgtttgtagcttatccatgccatctacagaatgaaaacatccaaatgcaaactagaaatagtagtgtttacttggtgaacctggctgtgatactttaagtttctggggttt

SEQ ID NO: 44966 - DNA, 930 bp, Homo sapiens
taccaaagcttcattctccttctaatttctccctttacaacctgtgtttctgagcccttcctcgtgcaagcatggaactcgtctgtgagccgttggctccttgcctttctgagtatcaaccagtgttcctggtatatagagagtggagagtgccacaggctctggggaaacggggccagctctactcggaggcccacctagctgggtcccctcacctccacctagaagacagagggggagactctttcctctaatgcttgttcttaatctttctccatatttctctccacatcccctgccaagcccccttcaatactgctgtcttctcatcagatcaagcccagcgccaatctttgcaatggatttttaaggcacagattctgaataatttgtaagggacataatctctagcttggcctaagacaccttgttctccctcttccttccagccagcagcaccttcctgtctgacccttggggttttgtgtcccttttagttaacccattttgccacagtccctaggacaaagccgcgtttttggttacagccctgtggggctcttgtttttgttgtgtatttttgttttttgggtttttttttagagacaccatcgcattctatcacccaggctggagtgcagtggtgtgatctcattgcaaccttaaactccctggccttaagcgattctcttaccttggcctcccaaaatactgtaattacaggcatgaggcaccacacccggtccagattcagcttctttaatctcatcttgaaatctttctcctcaaaggccaggcacctgtaatcccagaactttgggaggccgaggcagtaggctcgcttgagcctaggagttggaggctgcaatgagctatgatcacaccactgcactacagcctgggtggtgacagagtgagactctgtcttca

SEQ ID NO: 44967 - DNA, 986 bp, Homo sapiens
taccaaagcttcattctccttctaatttctccctttacaacctgtgtttctgagcccttcctcgtgcaagcatggaactcgtctgtgagccgttggctccttgcctttctgagtatcaaccagtgttcctggtatatagagagtggagagtgccacaggctctggggaaacggggccagctctactcggaggcccacctagctgggtcccctcacctccacctagaagacagagggggagactctttcctctaatgcttgttcttaatctttctccatatttctctccacatcccctgccaagcccccttcaatactgctgtcttctcatcagatcaagcccagcgccaatctttgcaatggatttttaaggcacagattctgaataatttgtaagggacataatctctagcttggcctaagacaccttgttctccctcttccttccagccagcagcaccttcctgtctgacccttggggttttgtgtcccttttagttaacccattttgccacagtccctaggacaaagccgcgtttttggttacagccctgtggggctcttgtttttgttgtgtatttttgttttttgggtttttttttagagacaccatcgcattctatcacccaggctggagtgcagtggtgtgatctcattgcaaccttaaactccctggccttaagcgattctcttaccttggcctcccaaaatactgtaattacaggcatgaggcaccacacccggtccagattcagcttctttaatctcatcttgaaatctttctcctcaaaggccaggcacctgtaatcccagaatagctgggattacaggcgtgcaccaccacacccaactaatttttgtattttttgtagagacagggtttcatcatgttggccaggatggtctcgatttcttgacctggtgatccacctgcctcggcccaaagtgctgggattctaggcatgagccaccgcgcccggccaatat

SEQ ID NO: 44968 - DNA, 417 bp, Homo sapiens
atcaccaggtgtggtggcacacgtgtaattccagctactcaagaggcttaagatgggaggatggcttgagcccaggaatttaagcttacagcatgtaatcatcgccacactccagtctggaagacagagcatgaccctttttttcctttttaaaaaaaaaggtcgtgtgcgatgtctcatgcctgtaatcccagcactttgggaggctgaagtgggtggatcatttgagatcaggaatttgaaaccagcgtgaccaacatggtgaaaccccgtctctactaaaaatacaaaagaattagcctggtgtggtggtgggcacctgtagtcccagctactcgggaggctgaggcaggagatcacttgaacctgggaggcagaggttgcagtaagctgagactgcgccactgcactccagcc

SEQ ID NO: 44969 - DNA, 816 bp, Homo sapiens
tcaaacaatcctcccacctgggcttcccgagtggctgggactacaggcatgcaccaccacacccagctaatttttgtattttttttgtagagacaaggatttcaccatgttggccaggctggtcttgaactcctgagctcaagtgatctgcctaccatggcgctgcaccccacctgccccctccaaaagtgctgggattataggtgtgagccactgcgcccaatctgagcagcactttctttatgcaagaaaagtgcctggcattcctggcctctatttagtagtgcccctcattcattatagtagccaaaagctgtcattgagaaagattgccctggtttataaatctggtagtaggttgctagatcacagcgtatgaatgtcttcaactttattaaataactgtcagttttctgtacaaagtacaacttccagtcccataatgcatgagagaggggtctgcttgtctgcatttcagatattttagaaggtagaaaaatattagtagtaatattttattaatttttgccattctgaggagtatgaaatggtacctcattgtagtttttatttgcatcttgttttaatgtattctttgtaataatacttggtaggcattaaaaatatcttccagcctgggcaacatgatgaaaccccgtctctactaaaaataccaaaacttagccgggtgtagtggtgggcgcctgtaatcccagctactcaggaggctgagacaggagaatcgcttgaacctgggaggcagaggttgcagtgagccgagatcgcgccaccacactccagcctgggggacacaat

SEQ ID NO: 44970 - DNA, 777 bp, Homo sapiens
atctgttatgcataaaaatcaatttcttgtaggttaaagattcaatacaaaaggggaaaccctgaaagcttttagaaaaataaagggacattatttaaggcagagaagaatttcttaagactcaaaaaactagccataaaaaatggacaaatttgactacattgaaaatagaaacttttttcattaagccccattaagacactcaaaaggcaaggcaaggaatagaagatacttataacacacactattagttatctattgttgtgtaattaccgaagacttagcagtttgaaataacatttctctcacagttctgtgggtcaggaaactgagagtggcttaattggatgtttctggcttagggccttgaggctgtaatcagtcaatggctgcagtcatttgaaggcttgactgctttgtgctccctcatgtggatgtagcaggcctcagagctggctttctagaagggagtaagagaaaacacccaagatggaaaccacagtattttagtcttggaagtggcaccccatcacttctgccatattctttttgttagaagcaaggcaataactccagcttacattcaaggggagtttgtacaaggcaccaccaggagggtgaggatcattgggagccagtttagaggctacctactacaacatgtaaagaatgaactggtatgaaaaatatacataaaaaattcctatagatttctaagacaaagacagaacaccaaattggaaaaagggcaaaaaatcctgagcaggcatttgaatt

SEQ ID NO: 44971 - DNA, 345 bp, Homo sapiens
ggagtgtttctccttcagccttttcccatttcagctagtgttacaaatcccaaatgtgagtctatgaccagcaaagcaatcaaagagaatcagtagtagacactaaaattcaagcagtctagccgtgcaggccactgctataaacaggaattaaatgctttccttcagctgagggtgaggcgataccattaacctgatcggccgaagcaggagtgggcaactggagcctgtgggccaaatcccagctgaggcccttttggttttgtttttggttttttgttttttgttttttttttttactgtcctggaggtaaggacaggttttacagtcttaaagcgtggttt

SEQ ID NO: 44972 - DNA, 863 bp, Homo sapiens
agtggtcaacacagtaccctggctccggtcaaagtagtcacagggctgtggattccacttcatgcaagtgaggaggcctgaccagttcactttgcttttggtacattctggaaaaataccccagagtgaacctggatgtgtgtgtgggagtgggggcacagatgattctcactctcaaataggcatctcaggagaattagagaatctgttattttgacctattcctgagctactattaaatagttacacaagctctctgcattaattttcttttccaaatgaccatctgtgaagtgtagcagtttctgggctcttccccaagtctgaattcagctgctaaatagtagacattccactgcaagtctatttctgtaagggttgaaaatacactattatggaaaatgtccaactgtggctttgtaccttccattccgtaatgtgctttcatttattcggcatatttattaggtattgactgtgtgcctagtactgtgctaggtgctagaaatactaagatgagtaagacatgtttcttgtccacggggattttatgtttcagtatgggagacaatacaggcaaatatacaactgacaagtagcccaagtcagtacagataaaagtgcaatgggacaccagaggagaggcttttagagaagatttcatagctggatggatagaatggctctacaaaaaagagaaaagaattttcagggcagagagaacaagggacacaaaggggaaaaagcaagtggcatgtttgtacagtagcaaattttctttggctggaggatattaaaggggaacaagcaggtatgaggctggaaaaatatgttaaagcaagaccctgtctcaaaaaaaaaaa

SEQ ID NO: 44973 - DNA, 468 bp, Homo sapiens
acactgaagcttgagaatttctattgtaaacagatgagctaagcagcccagaccttctaagaaaacttgttggtgagcatgacttagacatatcatgcttttaaattaaagatgctgagggggactcagctgtttctatctctttctgttagagaggtacctgtctgtgccctgggaggcaggcctctgcagcctgctcacccatggcctcctctgtgtatagcagctacagcagcttgaggctggagggctcagccccttgtggcaggggaaaacctgtcttttccttggaggggtgatttgtgggatggctaccaggtggaggtcttctcaaatagaatagattttcatctgtctagcatttatgatgtttgttatcacttttcattattatactagatattacttctgtcctaaaatatttgggagggaaccaaaataagtatgacccatttactttcttctcat

SEQ ID NO: 44974 - DNA, 2255 bp, Homo sapiens
  misc_feature (1359)..(1359): n is a, c, g, or t
ttagtaacggatatacatttgtaaaattacagactggggttaggagtgcagactgttattgtattgtgttcttgtgcaaaaaaaccccaggtgtatcatgggaatacatctttgaccttggacttccttgtgtcctgctggcagaggtcactagttttgacacctggtgagagatgtgaagtgttcctttatttacttatatttatttatttatttatttgaggcagggtcttgctctgtcacctgggctggagtgcagtggtgtgaacatggctcactttaccctccaactcctgggcttaagcagtcctcctacctcagcctcctgagtaggtaggactacagacgagcagcaccatgcccagccaatttttttatttttaattttttgtagagagaggatctcactatgttgctcaggctggtctcgaattcctggactcaagcagtcctcctgcctcccaaagtgttgggattattggtgtgagctgctgtgcccagccaatgcttcttttatatatttatttagatttggtgtttgatttttttgttaataagggaccttctcaaagatacttttaaatgaaaagacaaagggtcagaaaatactggtttttttttttttggaaacagtctcattctgtgacccagactggagtgcaatggcgttgatcttggctcacagtgacctccgcttcctgggtccaagtgatgcccctgcctcaggctcctgagtagctgggacaggctcatgccaccatgcttggctaatttttttgtacttaagtagaaatggggtttcgccatgttggccaggctggtcttgaaatcctgacctcaagtgatccatcctcctcggcctcccaaagtgctggaattactggcgtgagccactgcccctggccggttggctgctattttaacttaaggggtagaagactggaaaggaggacacatgcaatacagtgtgtatgagtatgtgtgtatttatatatgcttgttgtgtgtgcttagagtgactctagaaagctgtggaagagactgataacaatgctgttggggtaggtagattatgtagtcagatgtcagagagacttattttcatgtgtaaccttttgaactgttgatgttcttattaccattttgaaaaaaaaattgaaaaatcgaggcatgtggttaagcttttaaaaactttatttctttggatttggataggatggtcaaaagaagggggaaaatgatgttaatttctcctgtgcttttcagtcagttcttaaagagctgtaactgtatatttctgtaaacacttattttcatttttcagacttgttggcagaattagagtagtggtatgattancaagtgttgtttctgtttcatgactgggtccttagaccagtggtgaatcagtgatgatttttttttttttttgagccacagtcttgctctgtctcatccaggctggagtgcagtggtgcgatcggcttactgcagcctctgcctccagggttcaagtgattctcctgtctcattttgtttattttttttgtacactcatcaagatggtcttttccattgcacacaggagtgtgtggcattactgagtgtcatcatacactcactgtattttatttaaaagagatagactgggcgtggtggctcacgcctgtaatcccagcactttggaaggccaaggtgggcggatcacaatgtcaggagatcgagaccatcctggctaacacggtgaaacccggtctgtactaaaaatacaaaaaattagccgggcatggtggtgggcacctgtagtcccagctactcaggaggctgaggcaggagaatggtgtgaacccagaagacagagcttgtagtgagccaagattgcgccactgcactccagcctgggtgacagagcaagactccgtctcaaaaaaaaaaaaaaaaaaaaaaaaaaaaaagatagcagcatggctgggcgcagtggctcacacctgtaatcccagcactttgggaggccaaggcaggcagatcacgaggtcaggagttcaagaccagcctgaccaacatggtgaaaccccgtctctaccaaaaatacaaaaaattagccgggcatagtggcgggtgcctgttattccagctactcgggaggctgaggcaggagaatcacttgaacccaggaggcgggggttgcagtgagccgagatcgcaccattacactccagcctgggtgacaagagcaaaactccgtctcagaaaag

SEQ ID NO: 44975 - DNA, 1862 bp, Homo sapiens
  misc_feature (1359)..(1359): n is a, c, g, or t
ttagtaacggatatacatttgtaaaattacagactggggttaggagtgcagactgttattgtattgtgttcttgtgcaaaaaaaccccaggtgtatcatgggaatacatctttgaccttggacttccttgtgtcctgctggcagaggtcactagttttgacacctggtgagagatgtgaagtgttcctttatttacttatatttatttatttatttatttgaggcagggtcttgctctgtcacctgggctggagtgcagtggtgtgaacatggctcactttaccctccaactcctgggcttaagcagtcctcctacctcagcctcctgagtaggtaggactacagacgagcagcaccatgcccagccaatttttttatttttaattttttgtagagagaggatctcactatgttgctcaggctggtctcgaattcctggactcaagcagtcctcctgcctcccaaagtgttgggattattggtgtgagctgctgtgcccagccaatgcttcttttatatatttatttagatttggtgtttgatttttttgttaataagggaccttctcaaagatacttttaaatgaaaagacaaagggtcagaaaatactggtttttttttttttggaaacagtctcattctgtgacccagactggagtgcaatggcgttgatcttggctcacagtgacctccgcttcctgggtccaagtgatgcccctgcctcaggctcctgagtagctgggacaggctcatgccaccatgcttggctaatttttttgtacttaagtagaaatggggtttcgccatgttggccaggctggtcttgaaatcctgacctcaagtgatccatcctcctcggcctcccaaagtgctggaattactggcgtgagccactgcccctggccggttggctgctattttaacttaaggggtagaagactggaaaggaggacacatgcaatacagtgtgtatgagtatgtgtgtatttatatatgcttgttgtgtgtgcttagagtgactctagaaagctgtggaagagactgataacaatgctgttggggtaggtagattatgtagtcagatgtcagagagacttattttcatgtgtaaccttttgaactgttgatgttcttattaccattttgaaaaaaaaattgaaaaatcgaggcatgtggttaagcttttaaaaactttatttctttggatttggataggatggtcaaaagaagggggaaaatgatgttaatttctcctgtgcttttcagtcagttcttaaagagctgtaactgtatatttctgtaaacacttattttcatttttcagacttgttggcagaattagagtagtggtatgattancaagtgttgtttctgtttcatgactgggtccttagaccagtggtgaatcagtgatgatttttttttttttttgagccacagtcttgctctgtctcatccaggctggagtgcagtggtgcgatcggcttactgcagcctctgcctccagggttcaagtgattctcctgtctcagcctcctgagtagctgggactacaggcatgtgccaccatacctggctaattttgtatttttagtagagacgggatttcaccatgttggacaagctggtcttgaactcctgacctaaggtgatccactggcctctgcctcccaaagtgctgagattacaggcgtgagccaccgcacctggccaactggtgaattttgaatcctatccaagcttgatacttagaaaataatttagtgcaaactttaggaggttttggttgtccagaagtactacattttgtcttatttcaaaggtattgctttgccaagggtttggacattaggtgaatattg

SEQ ID NO: 44976 - DNA, 1260 bp, Homo sapiens
  misc_feature (757)..(757): n is a, c, g, or t
agggaccctatacactattcattccgaaatagattctctcctccttttccttctccttcttctttcttttttttcagagtctgctctgtgcccaggctggagtgcagtggcaccatctcgactcactgtagcctccacctgccatgctcatgccaccatgcttggctaatttttttgtacttaagtagaaatggggtttcgccatgttggccaggctggtcttgaaatcctgacctcaagtgatccatcctcctcggcctcccaaagtgctggaattactggcgtgagccactgcccctggccggttggctgctattttaacttaaggggtagaagactggaaaggaggacacatgcaatacagtgtgtatgagtatgtgtgtatttatatatgcttgttgtgtgtgcttagagtgactctagaaagctgtggaagagactgataacaatgctgttggggtaggtagattatgtagtcagatgtcagagagacttattttcatgtgtaaccttttgaactgttgatgttcttattaccattttgaaaaaaaaattgaaaaatcgaggcatgtggttaagcttttaaaaactttatttctttggatttggataggatggtcaaaagaagggggaaaatgatgttaatttctcctgtgcttttcagtcagttcttaaagagctgtaactgtatatttctgtaaacacttattttcatttttcagacttgttggcagaattagagtagtggtatgattancaagtgttgtttctgtttcatgactgggtccttagaccagtggtgaatcagtgatgatttttttttttttttgagccacagtcttgctctgtctcatccaggctggagtgcagtggtgcgatcggcttactgcagcctctgcctccagggttcaagtgattctcctgtctcagcctcctgagtagctgggactacaggcatgtgccaccatacctggctaattttgtatttttagtagagacgggatttcaccatgttggacaagctggtcttgaactcctgacctaaggtgatccactggcctctgcctcccaaagtgctgagattacaggcgtgagccaccgcacctggccaactggtgaattttgaatcctatccaagcttgatacttagaaaataatttagtgcaaactttaggaggttttggttgtccagaagtactacattttgtcttatttcaaaggtattgctttgccaagggtttggacattaggtgaatattg

SEQ ID NO: 44977 - DNA, 1450 bp, Homo sapiens
  misc_feature (947)..(947): n is a, c, g, or t
tcggaggtgctctcgaggatccaagataccaccgtgctatgattataaaacaatatacgccgacatttaacgaaaaaaacaaatagcgagtggcatattaaaaattagtaaagcacgggccgggtgtggagagatcaatgcctgcaatcccagcactttgggaggccgaggcaggcagatcagctgaggtcagaagttcgagaccagcctggccaacgtggtgaaaccctgtctctactaaaagaaaaaagagacaatacaaaattagctgagagtgctggcgcgcgcctgtagctgcagctacttgggcggctgaggcaggagaatcgcttgaacccaggaggcagaggttgcagtgagccgcgatcgtgccattgcactccagcctgggcaacaagagcaaaattccttctcaaaaaaacaaaacaacagcaacaacaaaaaaacacaaccaaagtgctggaattactggcgtgagccactgcccctggccggttggctgctattttaacttaaggggtagaagactggaaaggaggacacatgcaatacagtgtgtatgagtatgtgtgtatttatatatgcttgttgtgtgtgcttagagtgactctagaaagctgtggaagagactgataacaatgctgttggggtaggtagattatgtagtcagatgtcagagagacttattttcatgtgtaaccttttgaactgttgatgttcttattaccattttgaaaaaaaaattgaaaaatcgaggcatgtggttaagcttttaaaaactttatttctttggatttggataggatggtcaaaagaagggggaaaatgatgttaatttctcctgtgcttttcagtcagttcttaaagagctgtaactgtatatttctgtaaacacttattttcatttttcagacttgttggcagaattagagtagtggtatgattancaagtgttgtttctgtttcatgactgggtccttagaccagtggtgaatcagtgatgatttttttttttttttgagccacagtcttgctctgtctcatccaggctggagtgcagtggtgcgatcggcttactgcagcctctgcctccagggttcaagtgattctcctgtctcagcctcctgagtagctgggactacaggcatgtgccaccatacctggctaattttgtatttttagtagagacgggatttcaccatgttggacaagctggtcttgaactcctgacctaaggtgatccactggcctctgcctcccaaagtgctgagattacaggcgtgagccaccgcacctggccaactggtgaattttgaatcctatccaagcttgatacttagaaaataatttagtgcaaactttaggaggttttggttgtccagaagtactacattttgtcttatttcaaaggtattgctttgccaagggtttggacattaggtgaatattg

SEQ ID NO: 44978 - DNA, 448 bp, Homo sapiens
tctcatttgctttagaaactttcaaaagattcgtgttgtccacaggataaaattcaaactccttattgtagcattcatagtcctctgcatactggtcccaacataacatgtgaaacttcactttgtctgaactgaatttcaaatgtagttgtggtatgtatttggaaggaaaaaaaaatcccaaatgtattcttttttcactatctttatttttttcatttttggtgacaagagtctcactctgtggtccagactggagtatagtgctatcagagcttactacaactttaaacttctgggctcaggtgatcctcccacctcagtctcccaagtagctaagactgcacgtgcacaccacccagtccagctaatttttaaaaattttttctgtagagacaggatctctttatgttgcctaggctggtcttgaactcctggcctcaagtgg

SEQ ID NO: 44979 - DNA, 284 bp, Homo sapiens
ttttttttccaaatactgttctcagttctgctctgctcccacccttgcttccactcccactgtcaggtagctcattcctgggatcctttggattttagttcacacatcatttcctcagtgaaggtgtccctgaccaacattgcccctgaactccattagtcagctccccttgctccatttcatagtatcatctctctttttatcctctgtagttctcactgtaatcatatttatttctgtaattacttgattaatatttattttccccagaaaaccagtttctg

SEQ ID NO: 44980 - DNA, 257 bp, Homo sapiens
cccagcactttagggggctgaggaaggaggattgtttaagaccaggagctggaaaccagcctggttgacatagcaagaccccatctctacaaaagaaaaatttaaaaaattagctggatgtgttggatgcacctgtagtctcagctacttgggagactgaggcagcaggattgcttgagcctgggaggtggaggctacagggagttaggattgcaccactgtagtcccacctgggtgacagagtgagaccttgtctc

SEQ ID NO: 44981 - DNA, 508 bp, Homo sapiens
tagtgcatgtgctgtgtcactatcatcagaggtccaaattcaagagtctgttttcttgttaatataataacatgtccatcacgggatcttggtcccccaaggcaagagtggagtatggttaaaaaggaatgcagggaagggaaccagtatgtgcaagtcttggctcggtcattcaccagcagtagtgtggacaaattgcttaacctcagtttcttcatctgtaaaatgggggataatgatgcctacgtcatagggttggtgtgaagattgcttgtagcactgttgttctttgggtcagccctgttctaggaatgacaatctctgcatgctgactttcagcaggacgtgccttgaaatctttccccaaggactggttttggaaataaagccaatccatttgaactctctgttgtactgtctgcccctacccacccccatgcccaaatgtcacgcattgacaaaaaactggccaggtttagggttgtagtctgtgcatgtcgaaccttta

SEQ ID NO: 44982 - DNA, 1127 bp, Homo sapiens
cggcacgaggaataaaaataaaaaaaaatacacaaaaactccaagccgcaagtccttcatgcggtttaaactttgacctcagcagtctcgactccgggaaacaaaactatctcatcgtttttattttgtggtctgtacagagcctgtgtccgtgtgtctgtgtatgagcgagagagttggagggctggggagctttatgtgggggatggggagggcaaccccaggctaggctatgggctaggttagatgtccgaggttgggggccaagggcctgggctagaaagagaggagagatgagtgggttggagcagtggggagccctctgaatttctcttctccccaaccctgacctcctacttaagggagggacagagactgggtctaccctaatggtgggccttttcattgtgccaaaaaaaaaaaaaaaaaaattgatgccagtaactaaaccacctctctctgttctcttctggggggtggggtgggtgtgtgtgtgggggtgggtagggatggggaacccaagccccagtaggagttggggctgagatcaggaggaggggaaggatatgagttttccatccatctccctggagaaggccatgacgggctctccaagccctggggagatctggcgagggactagccaagtcagggtgacctcttgacctgactagtttttctaacccacatgaacaccagggtgcctctctcttcctctagcccagggtagggggacctgagtgagagagagagtgagacagacagcaagattgagacacgcgggcccccactggtctctgagtgggaaaggcaagtgcgagagataaaggcctccaagagaaaaaagaaacaaaccaaagatttaaccatttaaaaaaaaaaacccacagacaactccgctacctttttatatgttggaaaaaaagtgaaaaaaaattaaaaataaaaataaaaaaaaatacacaaaaactccaagccgcaagtccttcatgcggtttaaactttgacctcagcagtctccaaagcaagacgacgatgacaaaggcggaaacaaagaaaaaataatgtatatttttaagtatttgtccttgaattgttagctccttgttaaacaaacaaaaggagag

SEQ ID NO: 44983 - DNA, 277 bp, Homo sapiens
tggggccctggggcgcatctgtggaggactgaggggccggagcgggccagtcaacaaaggctttgattatatggatatttttaaaagagggagaccccgcattgtcaagtcttccggcccacatctgaaaacatcttcctggccttgggccaaagtctcatctgtccctcagaaggctctgacacctcgtcagtgcctcttggcgcccaagggaaagcattcccctcttgggaccaacttccttgactgctttccctcaccagcacccacaacaagg

SEQ ID NO: 44984 - DNA, 244 bp, Homo sapiens
gtcccacccttgacacatggggattattgcaatttatggtgagatttgggtggggacacagagccaaaccgtatcaatgaatgttttccccttaccccagtcttacatgaaaactgtatttctcaatatttcaccctttcccctttaaatttggaaccctcataatcatttttgaagaaaagcatagacctgtctccttggtgtgcatccttaacgttggcaaataaacctcctaaagtgataa

SEQ ID NO: 44985 - DNA, 370 bp, Homo sapiens
ctctattcagagaactgtggtaggtcaagctagatcttatggttaagtttggaggcctgtgaggccattttcctctacctaaactcaaaccttaatctcagagtcttatttgacagctgactgcaatgtgacagaaggccacaatgataagcttgattaataaaaacagaatagagaattgaccacaatcaagtattgatgtgtcgtggcatctgaccagtcagataaaagttaggtggaaggcacaacaaagtttttagttattatatcccttattctagaattctacatacaccaaatatgaaaggagttctaaaacagcattttgaacataatggaaatcagcatgtattcagctggagtgctattt

SEQ ID NO: 44986 - DNA, 81 bp, Homo sapiens
agcaaacccagtgtgggccaagtgtgcagtgctcaatggctgctctccttttcatctaatagcacagagccataaggctac

SEQ ID NO: 44987 - DNA, 230 bp, Homo sapiens
ccgttataatacttgaaaaatattaatatatggtctaatttcaaagcagcatggtaatgggaaacttttatttacactcaaccaatagaaagaaacaagggagtaatgtaaaagttgaaaacaacttttcagattagaagagcaggtacaaatttctcctctatctcaccactaagaaaataaaaccattttgtaatgcaaaataataccatgctttaaaatagtaactt

SEQ ID NO: 44988 - DNA, 378 bp, Homo sapiens
aatggaagaattaagcaagaatccccattctaatttctgttcaggcagcagaatggtcattacgagtcagtctgcagccaagccacccaggctgaactcccaacattctatgttctcctcctgtgtgtcctgctatgaacaagtcacccttcttgcctctcatttcctggtatgtaaaataagggtaaaaacagcacctgccacaagaggttgtgagaatgatttgaattaacactcttaaagtgtttagaataatgtctagcatgtaatatatactcattcagcattagctatggctactgttcttcacccctttgggctacatgccagactgttatgaatttaggagtgtgcccctatctgtctaactggggaaaa

SEQ ID NO: 44989 - DNA, 378 bp, Homo sapiens
  misc_feature (12)..(12): n is a, c, g, or t
attcggaacagngatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgctagctcactccgatccagtctcggccattcattttaatcgtgatggattcttgatagtttcaagtagctatga

SEQ ID NO: 44990 - DNA, 423 bp, Homo sapiens
tgcctaacgatgcatttctcagaacacgtctctgttgttaactgtactaagccattttatatatgggacttgagaatccttgggggtcccagaagcaatctcccacggatacagagggacaactgtatctaccagcccgtgtacgcgccacgaaaagtactgtgcttctggggaggctgcagacagggcagacctttctcacattgatcctgctactcagagaggcatggaggaacatagtcaagccggaagccagcctgggaggtgtgctctgtgtgggggttagggaggggattcacaggctgatcacctgggcagggcgggagcggccatgccagggaaagaggccgaggcagcaaggtggaaggagcacaccccgtggaaggcagggtggggctgatctcaggtctggggcaacagctc

SEQ ID NO: 44991 - DNA, 396 bp, Homo sapiens
gaggttatgaatattttaaacgcttttgacatttacttgcccattactttctaagagaattgcacccatttgtaccttttcaggcttccagattgcctttctagactcagatcattgtgccttttatgtagttcataatcttccactcacctttacttcttacatggctcactgtcatattactcactttaacttttgccgatggcttttcaccgtaattgagtacttccaggggactaacatgttgtcaggggtggttttcaagtttctgttgaaacagagaaaaatggtctcagttttcctgcacgcagtgcatcctgaacttggtaaagtatttggacaccccggccagtgctgttttcctttggcctggctttaaagcgagcctggcagtgc

SEQ ID NO: 44992 - DNA, 379 bp, Homo sapiens
attttcaagacctgaggacgtggcacactccatgtgtgcctggactcttttcagtgctgcttcctaaaggaaggtggaagaactaaaaaggggcccatgcccctctgtttactagggaaggaaattgctgtgcacttttgcctggggtttggtctaggattcttttgatgttgacttctagagcatttttgagactttttgaaataaatggctctaatgcctatagtagcagggaatgaagaatgcttaagatcagctagccttaaacgaacagacacttgttctgtgtctcccagccctgtctagggctgccgtgcagctgtaaacgagacagaccgagagcccctttgtcataacatacaggacctgtattttcttt

SEQ ID NO: 44993 - DNA, 383 bp, Homo sapiens
ttttttttattttgagacagggtcttgcactgtcacccaagctagagcgcagtggcacaatcatgtctcactgcagtctcaacccctcaagatcaagcgatcctcccacctcagcctcccgagtaactggaactatataggcacgtgccactgtggttggctatttctttaaatttttttgtagagatggggtctcactgtgctacgttgcccaggctggtcttgaactcctggctcaagcgattctcctgccttagcctctcaaagtgatatttttaaggcaattttttacattttatgggagaaatagcaatccctcatatccaaatccaatctccacccctccctgcctccaaaggtctagttatagaaaacgttttagg

SEQ ID NO: 44994 - DNA, 399 bp, Homo sapiens
cagtaattatataggatactttattatttgggttcacctttgctcagtagtgaattataagcactctactaggtgagaggtttggcttccaaaatgaacagctggcgcaggatggaactgtcagaccatgtcacatgataaataaaataatacatagaaactttaggatctcctaattggaagcttcctttagacaacaaaagatgccaggctatctgctgccccctaactggtaccatgaagaacagcacataactttttaaggaaacaaagtctgattcagggtacaattagttagtgggctgagtcaacctccctaagttataggttgtgaatttggccatttccatgaacctgtttgttgcgattaaggcaaagtcatcgggtagagtctgtttt

SEQ ID NO: 44995 - DNA, 421 bp, Homo sapiens
caataaacctaaaaaatactaataaataagctgagtgtggtggtgcatgtctgtaatcccaccaccacacccggctaatgcaatgaagcatttacattaagatatgtacactgttcttttagatatagcactatctgcatagtagactacagtataaacaacttttatatgcaccgtgaaaccaaaaacattgtgcgactcactttattacaatattcatcatattgatgtggtctgacactgaccctaccgcatctctgagctgtgccttgttaggctggtcaggcagggtccagccataagacaggtgcatcttcttcttgggccagtgagtgtcccagggaaggcacctccagtctcctgtctagaaatattgagcccaaataatggggtggggctgagcacctcattgtgttgactt

SEQ ID NO: 44996 - DNA, 6010 bp, Homo sapiens
agccctcccaggtgtgggacagaaggggcagagggagggcagaggcttaaaggctgtgagcagtcagatcaaaaatgaagccagctcttcctcacagccggtagatggaagtcatttttccagggcctggaaggagttggtaggaagactagatttcagccagcccttgcgccctgtttgtgccagcaggcaccagcgaaccaaaagcaggtgtccatgtctgcttactctgtgccttcaacttttgcccaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacgatcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgagtagtcatttc

SEQ ID NO: 44997 - DNA, 802 bp, Homo sapiens
ggctcggcccccatctgctcatcagtagcgactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgagtagtcatttc

SEQ ID NO: 44998 - DNA, 530 bp, Homo sapiens
aacaaggaacaaggactcggtccctggagcctgccctcccggtaagaaatgaatacagacaatcctcaagacgttatgaaatctgagattcctctatgtatgtatctacaagtaaggcacaccaaatctgtctctgcttgttcaaaccatggcaacagcattcccttatccacctgccctgcaagcaccaggtgagccactcaggaagacaccccagcagaagccactggcagatggctgacccaggtgccaccacggcaggaagcaggccgcagtcagctcccggccagcaccattgcccaagccagcaccacatcctcactgacacctgctctgcacagagtgccaccatcctctccaacaactctgggccacgaaccttgtcctagctgagaagggagattccgctgcaggcccctcctgcttcaggtcactcgtgatgctacaggacagacatatggcatgcacaggaacacggaacgcccttgcttctctaccaaaagtgacagcaaaaaaaaaagtcgacgcgg

SEQ ID NO: 44999 - DNA, 535 bp, Homo sapiens
gttaaactgaagaaaatgaagtactcttttcagttgtggatcgcaatgatgtccctctaacacggcccttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaccaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctgaaaaaaaaaat

SEQ ID NO: 45000 - DNA, 553 bp, Homo sapiens
ttataattatatattttcacctatttattattggtaaaataattgaaaaaatacgttttcaggaacaggtcttgatttctcacttattttgtttgttttcttcaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaccaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctgaaaaaaaaaat

SEQ ID NO: 45001 - DNA, 669 bp, Homo sapiens
gcctctcttctgcaggtctgctgcggttgctggacgtccaatccagaccctgttctcctgggtatcaccagtggaggctgtagaacagcaaatattgctgcctgctccttcctctggaagctttgtcccagaggggcaccaacctgatgccagctggagctgtcttgtatgaagtgtccttcgacccctgttgggaggtctctcccagtcggatgcacaaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaccaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctgaaaaaaaaaat

SEQ ID NO: 45002 - DNA, 1344 bp, Homo sapiens
ttggtgttcttgcaaggaggctgactgctgaagcattctattcagccatcctgctctgcctacacttccctataacaggtttgttgaggtataattcatataccatgcaatgtgcctatttaatgtatacaatgtaatggattttagtacatttagagttgtgcaacaatcatcacaattttagaatattttcgtcattcctaaaagagacctcgtactcattatcagtcactctacaacccactcgcacctccatagccttaagtaaccaagaatctactttctgtctctatagatttgattattctggatatttcatgtgaataggctcatacgtatgtgatgtcttgttactggcttctttcactaggcacaatatttcaagttttatctatattgtatcatatatcagcacttactttgtgtgactgagtaatattttatcaataaattttatttatgtattcatcaattgactggtattttactgttatgaatgattattcatatataagtcttgtataggtgttttggtctttactattttgagaaaatactcttgtattttatttctttccttcaatctcaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcccttcaactttgcttacacaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaccaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctgaaaaaaaaaat

SEQ ID NO: 45003 - DNA, 418 bp, Homo sapiens
gttaaactgaagaaaatgaagtactcttttcagttgtggatcgcaatgatgtcagcaaagggacatgatgggaaggaacctgtgaaatttgtagatttgcttggtgaccatgggaaacatgtcagtcctctgtgggagttgatcaaatggtgcctgggtctgtcagtgtacaccatcccttccattggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggcccttcaactttgcttacacaggtgtctgtactcaaagatctcttggaccatttatat

SEQ ID NO: 45004 - DNA, 278 bp, Homo sapiens
cactacaactacacacacaccacacagacacacacacacccaccacacctacacacacacacatcccaccatgccaacacaccacacacagacacatgcacatgtgagtgtatgcgtgcacacaccccaccacacctacaaataccacaccacacctacacacaaagccttcataaaaataagagccgggccgggcgtggtggctcacacctgtaattccagcactttgggaggccgaggcgggcggatcacctgaggttggcagttcaagaccagcc

SEQ ID NO: 45005 - DNA, 481 bp, Homo sapiens
agtagtcagatttgtgctttaatttgtgatctgcatcttttaaaaaaacttccttggtgacattgagaaagctgctccctgcatttatttataagtactgactgtttgactgctgtgctaacgtcccttgccacatgctggaaatgcagccgtgaacaagacaagtatgttctctgcccacatggaatttagattccagtaagggagacaggcaactgagtgcacaaataattatctaattataattgtggtaaatgccgtggaggagaagtacagcatgcctgagagcatttctcagggtaatcaggaaaggcttctttgagaaagtgattttcacctaacacaaggtttcattgtggccacctgggaaggtcttctgggctcacagagcagcagatgagaaggccctaaaggcagggatggtgcctggtgcctggagaatcccagaggcctgactgcctcctttgctcagcattcttcc

SEQ ID NO: 45006 - DNA, 349 bp, Homo sapiens
ctggcccctgacttatgtagtccttggtaccaggagtggtcttaaaacatggaccctccaggatggtttggaactggtttggtgtgtcttgccctgaacacagggctgggctcctcccagtgggaaatgggtcctggtgctctgtggcatgtgctggggtcacgcggcaggtgactgaactcctgaggtgccgggaccagccgggcagggccccttcctcaggggtccggatcccagctccctgggtctcttcaagcttctgacaaccccgacctctgcccgccaatctgtgtcaactcaatgctgccttcttgcttcctcagttctccaacacttgatgaagcaattc

SEQ ID NO: 45007 - DNA, 456 bp, Homo sapiens
caccggtataagggtgaggatggggatatgtgttcaattgcggggggaaaaaaacccttctagtttaaagacctggacactggagaagcctaggcttatcgaggaacagaggaggtggtgtcaaggaacaatttataatttagaggctgggaatggtaggggagagtgggaaataaagagtggttgattaatggggacaagtatatacttggaagaaataagacttggtgttcaatagatcagtaggatgactatagctaacatcaaccaattgtacatttcaaaatagctggaagaaaataatcaaatgttctaagcaaaaagaaaatatcagtatttaagatgatggatatcccaattaccctgacctgattatatgaatacatgaaattatcacatgtaccctgaaaatatgtacatttattaatgtagcaacaacaaaaaaatgaagctaaa

SEQ ID NO: 45008 - DNA, 251 bp, Homo sapiens
ctaacttatatatattttgaactctgaaccctgaaaatagagacaacccttccaagtacctagggacattcataaaaattgacaaaattcttttctaaattacaaactccataagaaattttaaaaaacagaaactatactgacaatattctctataatacaacaagacaaaaatgaacaagcaaataaaaaactaaaaactccaacatcttgtaaattacaacagctttttttcttagcccagtcttgga

SEQ ID NO: 45009 - DNA, 354 bp, Homo sapiens
aaaatatatggatgatggtgtgactatagttgtgggccagttagatagcttctgtcatgctgtttgtgtcttggttgccatagagacattttagctaacaagcccagcatggctctttgtagtcatttctttcagttcagatttgattttcttttcaggtaagattttgagacacgtgcatgtgtgtgtatgtatgtatgtatgtgtacgtatgtgtgtgtgcatatatagtgtatgtacacacacatatatatttacgctcatatcccaagttaccagagccttcagggcttttgaactgctggaaaatagctgcgtccggtgtttaaaagccagaagcccctgtctctggcc

SEQ ID NO: 45010 - DNA, 1289 bp, Homo sapiens
ttagacattttttaagtaggcacaaacaaccgaaaaatagataaatggacttcattaaaataaaaaacttgtatgcttcaaaggacactgtcaaggaagtgaaaagataatccacataatgggagaactatttccaaattgtatgtttgacacaggtctagtacctagagtgtataaggaattcatataactgagcaataaacgacaaccacatttaacaatggggaaaaaaagctgtgagtagaggtttctctaaaggaaacacacaaatggccaagaagcacatgcaaagatgttcaatgtttttcgtcattaggaaaatgtaaatttaaaccaaaatgagataccacttcacacccagcagtatgacttaagaaaaaaataaagacaacacatgtttcaaaagtgatggagaatatggaattctcatatattactattgggaatctaaaatgatgtagctactgaagttagtaaacagtgtgtgagttcctcaaaaagtgaaacataaagtgacatatgatgcagcaattgcactcctaggtttataaccaagaaaatgaaaaacagatgttcactcaaaaacctgtacaaagctgttcacagcagcattattcctaatagttaaaaagtggaaacatcttaaaccaccatgagttgatgaataaacaaaatgtggtataaccatatagtggaatattatctggccataaaaagttgaagtactgacgcaggctagaaaggatgaaacttgagaacaatattctaagaagcagatagaaaataccacactttgttattccatatagaggaagtgcccagaacaagtacatcaatatatagagaaggtagattagtggttgtcagagagcgcaagaaggggggaattggagagtgtctgcccataggtacaggcatgctttttggcattatgaaaatattctggaattaggtagtggcgatggttgcgaaagttttggaatatggtaaaagacactgaaatgtatgcttaaaaatggtgaattttgtgatgtataaattctactgtagaaataataataacaacaaaagtaataaagcaaggtgtctttccacatctccatgtccagtattttcattaaaaaaaagaaagaaataaaagcatttcagggccaggttcagtggctaacttctgtaatcccagcacttttggaggcctaggtgggaggatcgcttgaggccagaagttcaaaaccagcctgagcaacatagcaagaccttgtctctatgaaaaatataaaattagccag

SEQ ID NO: 45011 - DNA, 419 bp, Homo sapiens
gtgggtcacccgggtgagttcctgggagagttctttgcagggcccctgctccagccgctgggtgcagttcgtcaccagctgccggggggacctcagggatgaggtcaggaacctgtggctcaagaaaattctgcattagccgccgcccacatgccttccgcttctcatccggggtcgcttcatactcggccatcccatcctggaaggcgatgcaacggctcagctccggcctggtggcacagaactctcagaacagcaggcgcccgatgggctgccgctcgcacaggctgtgatagtcacgttcgagactgagccgcagctcttcgcactggctgatgtgggggaactggagcatctgccgccatttcttgcttttgcctttgcgatttccaccgctaccttcccgggccttgaggagc

SEQ ID NO: 45012 - DNA, 318 bp, Homo sapiens
gaacatctccatattctgtacatgtggttaaaaactgtcaaacaagggtgtggattatacaagtgtgtggattaagtacagaactctaagggattgatacataaaagagtttgaatggaagtttgataaaatgattaaaaggagtggttgacccttttttagtgaaggacggattatctttttctttaagaatgcttctgaatataaacttttacatattatatgtattaaaagataagagttgcttaatattaagtcttggtttttagattttgaaaaccaaatacacctttcagtgtggaaactgagtcttagaca

SEQ ID NO: 45013 - DNA, 409 bp, Homo sapiens
gtttttggcaattgtaagtaagactgctatgaatatttgtttataaagctatgtgtatgtcttttggatcagtacaagtctatgtgtttctctgttgtatcaatacctaggaacagagtggctgggtcatataagtgtgtatttaactgtctttatttattttgagacagagtcttgcttttgtcacccaggctgaagtgcaatggcatgatctcagctcattgcagcctctgcctcttgggttcaagcaattctcctgcctcagcctcctgagtagctgggattacagacgtgcgccaccatgccctgctaattttggtatttttagtagagatggggtttcaccacgttggccaggctggtctggaactcctgacctcaggtgatccacctgcctcagcctcccaaa

SEQ ID NO: 45014 - DNA, 381 bp, Homo sapiens
gagccgactcgggtggacggcctcccccgcgcccaggcccgggatctccgccgcccagtcctagggctccggcgtctcgggagctactatgttatgatatctcaaactaatatttgagactccttggcttgataactatgattccattgaagatgactattgagttgaatggctctgttttccatcaacgatgacagcttttaatcacagatctcaagcccattatgaacattaattaatgtctgacatcgcttaatgagagtcttgccctgttgcccaggctggagtgccgtggcttgatattggctgtctgcaacctccgcctcccgggttcaagtgattctcctgcctcagcctcccaagtagctgggattacaggtg

SEQ ID NO: 45015 - DNA, 2044 bp, Homo sapiens
gcctctttgcagttgagataagaggaaggcatctgtctccggctcgtccctgggcaatggaatgtctcggtgtaaagcccgattgtatattccatctactgagataggagaaaaccgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgccggcatgggtcctccgtatgctgaacgccggtcccctgggcccatttttcttcctctgtactttgtctctgtgtctctttcttttccaagtctctccttccacctaatgagaaacgcccacaggtgtggaggggcaacccatcccttcactgaaccatttttattcttccagaaatgtgattgataacagtaaagccacactcctcaagtgcctgaaatacccctcattgtcttcttcaggtggcaagggctctggaacagccacataaaggtgagggcaatatttttactgtagttctttcattgattggttgatcgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgtttttttcctagagctcaagctatttttccaggttcactacagataatgaaagagttcctattcttgtttgtgggggactgagggccctttttctgtgctggctgtcagcggggagacagtctactctgactccagaggccacatgctttcctccttacctgtctgtttcatctttcaaccaataacaactcatggagtccttctcaagctcccaccttctctgacttcatcttctccaaccagccacacaaagctctgtcatgtatggagtgatgtgattagatccagttcatgcggtaacctcaccatcttaaagtcatataactggcatataacaacatagtcacaggaatggtgtctcatcaccttaagaggctttagagacaagggtgtggcatgtttggggaccatttcagaaattccatttaccacagtaggacactcacattcccccatctgcaaagtgcatttaccctctcccctgaggtttccagatttcatgtcattaaagcattagttcaacatgaaaaatgtcatgtagaccacatcagattcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcattttcctcacactcttttgcgtatggctcctattgcactcaaaatgtttttgagattcatccatcttgttttgtgtgtcaaaagtttgttcctttagccgttccatggaatgaatgtatcacagtttattgatccattcttgtattgatagatatttgaatgtttccagtttttcctattatgaataaaactgctatgaacattcttgtataaatcattttctggaca

SEQ ID NO: 45016 - DNA, 1762 bp, Homo sapiens
  misc_feature (18)..(18): n is a, c, g, or t
aaggctcaggtgatcctnctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacaggtggcaagggctctggaacagccacataaaggtgagggcaatatttttactgtagttctttcattgattggttgatcgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgtttttttcctagagctcaagctatttttccaggttcactacagataatgaaagagttcctattcttgtttgtgggggactgagggccctttttctgtgctggctgtcagcggggagacagtctactctgactccagaggccacatgctttcctccttacctgtctgtttcatctttcaaccaataacaactcatggagtccttctcaagctcccaccttctctgacttcatcttctccaaccagccacacaaagctctgtcatgtatggagtgatgtgattagatccagttcatgcggtaacctcaccatcttaaagtcatataactggcatataacaacatagtcacaggaatggtgtctcatcaccttaagaggctttagagacaagggtgtggcatgtttggggaccatttcagaaattccatttaccacagtaggacactcacattcccccatctgcaaagtgcatttaccctctcccctgaggtttccagatttcatgtcattaaagcattagttcaacatgaaaaatgtcatgtagaccacatcagattcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataaccactacagtgattctagttcaaaatgagggaacatggaggggataaagaagtcaataacccaaaatagtttggaaatggagctgggcaaaatccagcaggagtttcttagttaggatccacagcctgggactgaccctctgtcctgtgggtctttgcctctgggctctctgctctgcatttcttgaaaccattattatttatcattttcctcacactcttttgcgtatggctcctattgcactcaaaatgtttttgagattcatccatcttgttttgtgtgtcaaaagtttgttcctttagccgttccatggaatgaatgtatcacagtttattgatccattcttgtattgatagatatttgaatgtttccagtttttcctattatgaataaaactgctatgaacattcttgtataaatcattttctggaca

SEQ ID NO: 45017 - DNA, 931 bp, Homo sapiens
  misc_feature (18)..(18): n is a, c, g, or t
aaggctcaggtgatcctnctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaaggtgcgtactcaaacacagagagctttgtgaaagatgctaccagtagtttttccagggcagagatgggtcctttatttttctctctaatctagcccatatgcttagctgagttttcttcgtatcactttaaatgatgatgtcccttgttcaacaattttctaaacattctttagataataattttatgggcattctttactgcattaggcttaaatttaatgcatcttaaggttttattgcaaaatattgccttgtttcctttttaagatgatacagtttataatatgcaaatttgttgtgtcccctccctttatgtacatagaaaatgagcaaacaggtggccatgaaacagatggtcatagaattggtt

SEQ ID NO: 45018 - DNA, 737 bp, Homo sapiens
ataggagtgtgccaccatgcctggcttaattttcatattttttgtagagatgggattcaacatgtttcccaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacagatggagttatttctcttttccttgggctcaaatgcaacggcgccatctcagctcactgcaacctccacctcctgagttcaagtgattctcctgcctcagcctcctgaatagctgggattacaggcgcctgccaccgcacctggctaatgtttgtatttttggtagagacagggtttcttcatgttggccaggttggtctctaactcttgacctcaagtgatccacctgccttggcctctcaaagtgctaggattacagacacgagccacggcctgacctgaactgtggggaaaagaaagagagatcagattgttactgtgtctgtgtaggaagaagtagacataagagactccattttgttctgtactaagaaaaattgttttgccttgagacgct

SEQ ID NO: 45019 - DNA, 884 bp, Homo sapiens
  misc_feature (18)..(18): n is a, c, g, or t
aaggctcaggtgatcctnctgcctcagcccccaggtagctgggacctacaggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctgggggtgccaccaactcccactgtccagggcttccagtggactctccgaggtactgatgtagaaacttccccattcggtgcaccaagagcaacctcacacggtgtgggccgaatgaagagctgccagatcccacaggtggcaagggctctggaacagccacataaagcccttgaagataaggatggtcaaacaaaataatatcatacctggagaaactcagatcttggtaagatttactggttgggaatccaaagttaatgccaagaagcagccgccagttgggatcaaatgtgagcctatggatcaagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacatccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaaagagaaatgttttctaactcaagtggccggcttcctggccaacgacagaagaaataccaatatgaagagtgcaaagatctcata

SEQ ID NO: 45020 - DNA, 3581 bp, Homo sapiens
  misc_feature (1)..(1): n is a, c, g, or t
  misc_feature (6)..(6): n is a, c, g, or t
  misc_feature (8)..(9): n is a, c, g, or t
  misc_feature (1263)..(1263): n is a, c, g, or t
  misc_feature (1359)..(1359): n is a, c, g, or t
ngcacnanngtataagcaaccctaccataaaggacaatgggacattcagctgtgctgtgaagaatcccccagatgtgcaccataatattcccatgacagagctaacagtcacagaaaggggttttggcaccatgctttcctctgtggcccttctttccatccttgtctttgtgccctcagccgtggtggttgctctgctgctggtgagaatggggaggaaggctgctgggctgaagaagaggagcaggtctggctataagaagtcatctattgaggtttccgatgacactgatcaggaggaggaagaggcgtgtatggcgaggctttgtgtccgttgcgctgagtgcctggattcagactatgaagagacatattgatgaaagtctgtatgacacaagaagagtcacctaaagacaggaaacatcccattccactggcagctaaagcctgtcagagaaagtggagctggcctggaccatagcgatggacaatcctggagatcatcagtaaagactttaggaaccacttatttattgaataaatgttcttgttgtatttataaactgttcaggaagtctcataagagactcatgacttcccctttcaatgaattatgctgtaattgaatgaagaaattcttttcctgagcaaaaagatactttttgattcatctttgctctggaatgtattacatgttttcttccaactgtttgaaggagaattttgaatgtttgccacaccgctgatacccaaataattttttaaatgaagtggagcttgtggcttcctgatgtgtcaccagacaaaatattcgcttgggatatgtattctttgttttttgctccatgtacactttcagctgtgagttagtatagggcgtatacttaccggtttaatgacctcaacctcagttgtgtttggataacttagggtgtatacccttagtttccttagagttggtaggatcaagtcattggtttgctttgactgggtttttaaagtattaagtacagtgtcatcaatttacagttaaggaaaggaatcgtgaagtagaaaaattattttctttagtcttgctggtacaatttgggctaaggagtctttgttattttctgtcttgcttttttttttttttgaggcagagtctcactctgtcgccaggctggagtgcagtggtgtgatcttggctcactgcaacctctgcctcctgggttcaagcgattcttgtgcctcagcctctcgagtagctgggattacaggcangcgccaccacacccagctaatttttgtgtttttagtagagacggggtttcaccattttggccaggatggtctcaatcccctgacctcgtgatccanctgcctcggcctcccaaagtgttgggattacaggcatgagccactgtgcttggcctgttattttattttcttataactacaacttttcttcttgaattttcaggtcagaggcaagaaaaactctttacaggtttttagtggggggcttatggagtatttcaggagttctttgcaaattaaatcatcttttcacttgtattgtttttcaaaactttgttgatttctaaaatgtgccaactgtgagtaaactatggtatttgcaagtggtttttacataatatttgagatgaggaagtgagattgtgcatgacatacttctcctttgtattctctcagtgccttacagcaggttactccattctgctatgacaacttgtttcaaatgttaatttacataggattttttataagccattaaggcatatgtatagtatatcagtaaagatggatggtgcatatataaatagtcttctgtaatagtgattggatttacttctcaattatgagagacaaaaattatcccctcacctgtctctattctttcaacaggttgatcccttttcatgatttttcattaggtggttcaggaagtttccatattacagcgcttcagactgtatatgttagtttaaaaatcacttttctctctctcaacttctttcttttttttttgaagacttaatttaaaaaatttgggttgttagatccgtatcatagatttggcctagcctcttctgttaacctagtccacagatgagcgaatctggttagttgaaggacattgtgatttgactctggtcacgcgaggaagtagaagggcaaagacaggaccggcagtttacatttccagtggttaaacctcacggtactttgggactgcttgttaacttttgtggttgtctgaggccaatctaacgtgaccatttctgacacctcaacagagagaggaaagcaacttgagcaatgagagtaaataacttgggctctcagagatttgaagatagagatctcattgtgagggggactattttgcaggtcctcatttctccaagaaagagatggtgttacaggaacccactgaaagccatatcccattaaatgaggaactaattttggctgggccttcttgtaatgtcctcgcaggtgtgttgtgaagattaatgcagggtagtatgtttgtagattgacacctagtctaaacttgaggtaattggtgctctgtgaatactcagtcgtgttcttttatagccttaatcatgatttgaactagtcccttgctttttaaatgactgaatgaagtccttcgtggtaagggagtacgttgataacttagtttactatatgggtttgtggtcgcatcccagtcatcagctgctatcattttccttcttcatcccttatactgagatttgggttacagctttttattcttcgaaggatcacaaagcagtgtacagacacctgccttctttaaggatgaaaggaagataaagtggtctttttttgtttacttatttgtttcacctcttgtttgagtaacttctaaggtgctattctctctctctttttgctaccccatgagctcttgtcacagccatggaaaccagcctcgtttagaaagggaacttagttcagaaggggttaaaagccttccagaatttttctttagctgctgaagtttttacatgtggttacatgactttaagttttatgcattacgctcttaattctattacaaaatgtggactcaccaattgctttgtgttttccatgtgacctgttacttcaggctacttggggaacatcttagtcctctgtagctcctgaacccagcactggtgcttcaagagagaaggtagcacgtctttgttcaaaacaaaacaaaacgacacttctggaggccacatcctgaatatgaatgttctactaagtcactcagttatggttctaaagggaaactgtaagaagacccacaaggagtggaccaagactattatttaattgcacaacttgaaactttgctgccagaagaggcagctccattcctttgactccagtgttgggctgttaactgctgcacctcattgcctttttttgtttttgtttttgttttgtaggagggtaggcactgttgggccatatgcacaaatattgtaactcttggtatctttactgcatcatagtcaataaacttctttgtaccctttggctaaaaaaaaaag

SEQ ID NO: 45021 - DNA, 4765 bp, Homo sapiens
aaattaacacgataccctatacaaaagggaatgctcagagttaacagctagagaagagaggcgccaatcttagacacaggcttattcctccgcaccctcccccaaaacaaatggaggacagaagaaaaaagaaaagtagttaatacaactattactctacggaaatattaggggtagcgcaaacaaagttctgacactaaactttactgagccctgcatcctgcccacgacccccccagaaacacctacgcaccactctcctagccgccgcagacccgccagtctcgccgggaggaacccccagcgccgcggtacaaccacggcacttccgcccgccccccgcgcctcgggcgcaagcgtttggtgtgtctgcgtcgggggcggagcctcttgtccctctgcgcggcccgttccgcctctcttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtcgagtaaacattgttgatctacaacaggtaattaatgtggacctgattcatattgaaaatagaattggtgacattattaaatcagaaaagcatgttcagttagtgttgggacaactgatagatgagaattatttggatcggttggcagaagaggtcaatgataaattgcaagaaagtggtcaggtcaccatatcagaactgtgtaaaacttatgatcttcctgggaactttctgacacaggcactaactcagcgacttggtagaattatcagtggacatattgatcttgataatagaggagtaatttttacggaagcttttgtagctcgacataaagcacgtatccgtggactattcagtgctattacccggcctacagctgtgaattctttgatttcaaaatatggatttcaggagcagcttctttactctgtgcttgaggaacttgttaatagcggacgcttacgaggcactgtggttggtgggagacaggataaagctgtgtttgtccctgacatctactccaggacacagagtacttgggtggattcctttttcaggcagaatggctatctagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcacctctgctacccacttctttatcagttgaagatgctgccatattgcttcagcaggtgatgagggcattcagcaaacaggcctcaactgtagtctttagcgacactgttgtagtcagtgaaaaatttataaatgactgtacagaactgttccgtgagctgatgcaccagaaagctgaaaaggaaatgaaaaataatcctgtgcatttaatcactgaagaagatctgaaacaaatctccactttagaaagcgttagtacaagtaaaaaggataaaaaagatgagcgaagaaggaaagcaacagagggcagtggaagcatgagaggaggaggtgggggcaatgccagagagtacaaaattaaaaaagtcaagaagaaaggaagaaaagatgatgatagtgatgatgaatctcaatcatcccacactggaaagaagaagccagagatcagttttatgttccaggatgagattgaagattttttaagaaaacacatacaagatgcccctgaggagtttatttcggaacttgctgagtacttaataaaacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcagatgacacacaggctgctcttaccaaacacttgctgaagtcagtgtgtactgatatcactaacctcattttcaacttcttagcttcggatttaatgatggcagtagacgatcctgcagccattacaagtgaaataagaaagaaaattttaagtaaattatcagaagaaaccaaagtagctcttacaaaactccataactctctgaatgaaaagagcatagaagactttatttcttgtctggattctgcagcagaagcttgtgatattatggtgaaaaggggagacaaaaaaagggaaagacagatactgttccaacatcgacaagcactggctgaacagctaaaggtcacagaagaccctgctcttattctgcacctcacatcagtcctgttgtttcagttttcaacccacagcatgctccatgcacctggaagatgtgtcccacagatcattgcttttcttaatagtaaaattccagaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttacaaaaaagaaaaattattactaagcccttgctcttatttttggcagaataaacattgattttggttggggctgcaaggatgcctttacaggtgcacaagaacgctagagtggcccatgcattgctgtgttctcttctaaaacaagctactaacaagagagagaacacatgcaatttattaccagtaagcataagtcatatttaacattggaataactaagcattttatacaaagatttttctttgacccagtttgcatttgtacattttatttttttagttcaacagctgctctgtcacataatactttgtaaatactagtgtgaaaaacagataggatgccttttccagtggtaggagcatctgtaagtgcatttaaatcattagaagcttttttccaaaactagaaacccttattaaaaaatagacatttttttctaaagattattagttaaaaataactaaaagagttccttagagtaatcatttcaaccaaatgaatttcaagcaacaacttacttactatttatcaaaaagggatttaattattttgaatataattataaattaaatttcaaatatttaaaaatactattttatataattccttatgacattttaaactttatattttaaaatatttgaatacgaaaagatcagtctacctctactccattctagacaaagtattaatccttagtgaaagtaattaattaaattgccaacttggcattattattaaacttgataggaacgcaacattaaatttaaaaatgttttcccgtgggtaattttctattatatattttcatatgggcaaagggaaaaaatgataaatcctctgtaatcacaaaccccaatttcgttttgtttattcagcttctaaaatattgaacacccagacttttaattcaacctttaagaaccttatcatttatgtttcagtagatatcaaagtaatccatgtttgtgtcaaatgatcatagaaaataaatagaagagacagtgaagcaagtaaaaagaaaagcattgttttaatttgtttgcattaatttttttcatttgtcaaaatgcttcttttgttgccacagtaaagaacagtttttattgttttgtaagtaaaattacgtagctgattttgtatgtaaagattaatttccataataaaaattattgtatgtttactgtgatcttaatgggcagggttaagaaagttatttaaaataaagttacctattctactaaattttatagtactttgaagcttctattaattaacacaaagattaattggtgcatatattttatatatatacattttgaattctcattttgaacattattaaaggattttatttttcttacac

SEQ ID NO: 45022 - DNA, 673 bp, Homo sapiens
aaattaacacgataccctatacaaaagggaatgctcagagttaacagctagagaagagaggcgccaatcttagacacaggcttattcctccgcaccctcccccaaaacaaatggaggacagaagaaaaaagaaaagtagttaatacaactattactctacggaaatattaggggtagcgcaaacaaagttctgacactaaactttactgagccctgcatcctgcccacgacccccccagaaacacctacgcaccactctcctagccgccgcagacccgccagtctcgccgggaggaacccccagcgccgcggtacaaccacggcacttccgcccgccccccgcgcctcgggcgcaagcgtttggtgtgtctgcgtcgggggcggagcctcttgtccctctgcgcggcccgttccgcctctcttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagagatttgaagattggaagcaggcctgtaagagacaacagacttgaaatttgtgatgggatgatgtgtaccaattaaataaatgatttaagcatatgtaaacctaaatactct

SEQ ID NO: 45023 - DNA, 745 bp, Homo sapiens
aattctatgagatgatattgttattatccccatttcacagatacggaaatggagaaataaggaaaatgacttgtctagtgtttcatagctagtaggtggcagagttgaggtttagacttagtctgactccaacattgatcctcttaaccaaggcattacacttctcttataggtagggctgaaatgtcttacttcaacgtaaacagcggaaatggaataactctttaaactgcttatagttgtatttcacactactgattctattatagtctaggtgtcttgatttttttaaatattaaaaaacggaacttgttaacactaataattgcatattacctgttcttgaagtgttttatcatctgtttttagtaaattatgagatagataatggcatgctgtgttttcaccaaaattactcaaactaaaaatttcagtgttaacattaactagcttgagttacaagttcaacacctttagctagttgccaaaatgcaaaacttccctgaatttatgttttgaatattctcataaatggcaggaaaattttgtctaaaatatactacctttatttatgctatttcaacttcagattggttttttaaaggttaagaataagtaaattatgaaataataaagtattttactttttaagatttatacctggtctgatttatttgtattcatgtgggtttgttttaagctgtgcttgaggaacttgttaatagcggacgcttacgaggcactg

SEQ ID NO: 45024 - DNA, 660 bp, Homo sapiens
gcagttcctccgcgtctactgcgagtcaggccgtgatggcggacgcctgggaagagattaggcggttggcggccgacttccagcgggcgcagttcgccgaggccacgcagaggtgcccgaccctccctctcctttgtggagcccaaattaggccgtgggcggacacgcctgtatctgggactttagacccgcggccctgcatcccgggtcttctcgctgcttgtcaccattctctcctcctccctctgtcccgagcctggatcgcagttccaagtccaaggctcggcgggaaagtcctcagcctaggacgccctggagccccccagcccagctgcagcgaaatgctggcgcgccccgccccaccatggacggggccggtgatttcgagctgcctttattgagcatttctttgaccctccctcacccaccaaccaccaaatcactgtgacatcttggctattatacacttcctgatctagaatgagctcgaaaggagaggctaacccccgcccccagtacagtacttggcaaatagtatgttgatccttaaaacttcttgcccttttatctctcgtaacagacctagggctagacccctgaccccatctgttattcagggcactgacattttctacaagcccactaacctttggaggatgt

SEQ ID NO: 45025 - DNA, 418 bp, Homo sapiens
ctaatcattaatagattttgtatttgttttccaggtaattaatgtggacctgattcatattgaaaatagaattggtgacattattaaatcagaaaagcatgttcagttagtgttgggacaactgatagatgagtaagtacaataaagtacaaatttaagagcactttgtttattttctttcttttttttatagtgtttaaatttaggccaattatggccagttagacatttcatttataactcttacagtgttgattttcatgataaggtttatttcacttaaaaagtaagtgtttaagccacatatggtggcatgtacctgtaatcccagctactcagaaggctgaggctggaggattgcttgaccaggaatttgagaccagcctacgtaacatagcaaagatcctgtctcaaatta

SEQ ID NO: 45026 - DNA, 3401 bp, Homo sapiens
aaattaacacgataccctatacaaaagggaatgctcagagttaacagctagagaagagaggcgccaatcttagacacaggcttattcctccgcaccctcccccaaaacaaatggaggacagaagaaaaaagaaaagtagttaatacaactattactctacggaaatattaggggtagcgcaaacaaagttctgacactaaactttactgagccctgcatcctgcccacgacccccccagaaacacctacgcaccactctcctagccgccgcagacccgccagtctcgccgggaggaacccccagcgccgcggtacaaccacggcacttccgcccgccccccgcgcctcgggcgcaagcgtttggtgtgtctgcgtcgggggcggagcctcttgtccctctgcgcggcccgttccgcctctcttctcccaccgcctgtcggctgacgtgtctgcagttcctccgcgtctactgcgagtcaggccgtgatggcggacgcctgggaagagattaggcggttggcggccgacttccagcgggcgcagttcgccgaggccacgcagaggttgtccgagcggaactgcattgagattgttaataaattgattgctcagaaacagctagaagtagttcatacactcgatggaaaggaatatattactccagcccaaattagtaaagaaatgagagatgagctacatgtccgaggtggtcgagtaaacattgttgatctacaacaggtaattaatgtggacctgattcatattgaaaatagaattggtgacattattaaatcagaaaagcatgttcagttagtgttgggacaactgatagatgagaattatttggatcggttggcagaagaggtcaatgataaattgcaagaaagtggtcaggtcaccatatcagaactgtgtaaaacttatgatcttcctgggaactttctgacacaggcactaactcagcgacttggtagaattatcagtggacatattgatcttgataatagaggagtaatttttacggaagcttttgtagctcgacataaagcacgtatccgtggactattcagtgctattacccggcctacagctgtgaattctttgatttcaaaatatggatttcaggagcagcttctttactctgtgcttgaggaacttgttaatagcggacgcttacgaggcactgtggttggtgggagacaggataaagctgtgtttgtccctgacatctactccaggacacagagtacttgggtggattcctttttcaggcagaatggctatctagaatttgatgctttgtccagacttggaatcccagatgctgtaagctacataaagaaaagatataagactacacaactcttgtttttgaaagcagcttgtgttggtcaaggacttgtggatcaagtggaagcatcagtagaagaagccatcagctctggaacatgggttgatattgcacctctgctacccacttctttatcagttgaagatgctgccatattgcttcagcaggtgatgagggcattcagcaaacaggcctcaactgtagtctttagcgacactgttgtagtcagtgaaaaatttataaatgactgtacagaactgttccgtgagctgatgcaccagaaagctgaaaaggaaatgaaaaataatcctgtgcatttaatcactgaagaagatctgaaacaaatctccactttagaaagcgttagtacaagtaaaaaggataaaaaagatgagcgaagaaggaaagcaacagagggcagtggaagcatgagaggaggaggtgggggcaatgccagagagtacaaaattaaaaaagtcaagaagaaaggaagaaaagatgatgatagtgatgatgaatctcaatcatcccacactggaaagaagaagccagagatcagttttatgttccaggatgagattgaagattttttaagaaaacacatacaagatgcccctgaggagtttatttcggaacttgctgagtacttaataaaacctcttaataaaacttatctcgaggtggtacgttcagtattcatgtcttcaacaacttctgcttctgggacgggcagaaaacgcacaatcaaggacttgcaagaagaagtttcaaacctgtacaataacattaggttatttgaaaaagggatgaagttttttgcagatgacacacaggctgctcttaccaaacacttgctgaagtcagtgtgtactgatatcactaacctcattttcaacttcttagcttcggatttaatgatggcagtagacgatcctgcagccattacaagtgaaataagaaagaaaattttaagtaaattatcagaagaaaccaaagtagctcttacaaaactccataactctctgaatgaaaagagcatagaagactttatttcttgtctggattctgcagcagaagcttgtgatattatggtgaaaaggggagacaaaaaaagggaaagacagatactgttccaacatcgacaagcactggctgaacagctaaaggtcacagaagaccctgctcttattctgcacctcacatcagtcctgttgtttcagttttcaacccacagcatgctccatgcacctggaagatgtgtcccacagatcattgcttttcttaatagtaaaattccagaggatcagcatgctcttttggtaaagtatcaaggtttggttgtaaagcagctagtcagtcaaagtaagaagactgggcagggagattatcccttgaataatgaattagacaaagaacaagaagatgttgccagtactactcgtaaagagcttcaagaactttcttcatccattaaagaccttgttctcaaatctaggaaatcatctgtgacggaagagtaatgatcttaatttacatttgtcatatagtaagcattttcccccaaggttgaaggtgagtggtcacaaaaaagtagtcactatacaactcccctctccctgcaaaaaccacctcatacacacacaattcagttaaaacagtagtattgtattaaatgtaaatcttaaaaagatgtgaatttttgtaaattgggttcttcatggaagtttttttccacctgattttcacacaaatactatatgaaatttttcacattattttcacataattttaaaaattacatatttcaggtttgttctctttccaaatgttgaatgaaaaacaaattttccaatccatttatccctggggaaggattcatttgttgcgagtgccagtatacttaaatgtatactttatatacatttaagcagaaatttaaaatgtggtcttttttttttaaaagaaacacttctgtgtcagaaatgaaaataaatcatgttttttatttttaaatagaaagcacttcaaaactaaaatacagaaatttaca

SEQ ID NO: 45027 - DNA, 392 bp, Homo sapiens
agtagctatcagtaaatttgggggaagtcaaaagttagatacagatttttgactgcacaggggttgatgccccaaactcccgtgttgctcaagggtcaatcgtatatcatttcaaacccccatgaagacccagacagcatgtttggggtgggagtgggccatgccggggatggccttgtggaaggcaggcgtttaggcgcagtactctaaagcaggtgggctcagctgagggcccaagcctagaaccgctggcagacacatgttctcagtaaggggcctgggccgccttgccatccacttggctctcttgggaagagctcaccacaccctcggaaacttcctgagctctgattccctggggggtggtgaagaacagcgctgtatcttaaccc

SEQ ID NO: 45028 - DNA, 347 bp, Homo sapiens
ggctctgcaaataatgaaaaagataaggagatcaaaaggggctttctttatccctgaataagtaagccacatatttgttaaaggtttataggggtagcagtgccttttaccatgattactgtatatgtaaaatggaatcactctaatctcacagggttgctatgaacagcataacccttaggcccaggaactttagaaggccccacactttagagggccagttctggccttcctctggctgtggccctttctgtggagcaagaggatatgttcgtctggagcccatgctcctctgtctccctcccctgaccatgatcttgaaccacagaattccctgaccaaatggc

SEQ ID NO: 45029 - DNA, 437 bp, Homo sapiens
ttccattttgctgcttaccataaattggctcctactcttaacctccctaacatagcaatgtcccttgttcttgaagaatctctctccccacaccctcttctcatccctcctcttgtactgtcattttgctatgttgcccagcctggcctccaactcctagactcaaacaatccacccatcctggccaacaaaagtgcctgggatgaatctgtaattttgatgaatattgcccaaattgtattcccatagggatggtattactttgttctctaccaataatgtatagaaatgtctgtttttctaaaatattgtcaatagaatgtgttgttttactaccactttgctttctaaatgacttgtaacaaattcagcaccccttacctacccttgccaggcatgtgtggaatactggataataaactgcttttgaatgtttt

SEQ ID NO: 45030 - DNA, 407 bp, Homo sapiens
gcactaatttctgtctgtagattgagtctctgctagaatcaaatgccactagttctaagtgaaatctgtcattaaaaaattttaattttgaaaatttattgcttagagccttattctttcttgagaagcgcatgccgttttgctttaaatttgttttctcaataaattttaatatttatttgcccttttatcatgacattgaactgcatgtttatgaagcctataaattatggtttcatatgtcatttactaggtggaattattttaatacttatcagacacatggaaacctagctttgtgccctacactacattttgaatttggggctgcccctttaaaaattatacctttagagctaacaaatttctgatctgttaaagttttatggcatggcatagtttatgcc

SEQ ID NO: 45031 - DNA, 458 bp, Homo sapiens
atttcgactttacttgctgtaacacccaaaaatgcagagtgaggttgatttcacctagaatttgtaaataagacctggcctctgcctggaatttacaaggcaaagccagactttggattgagaatttacagaaaaccaacaggaggcattttctgcattgtgagatatcaacatagacattttaatttccttttttgagagtgtggccttttgacctttcacatcttcattaacctgccccagttatgtgagaggctccaggagtaaatagaatctgatggcagaatctgtaagtgtaaacaatcatcttaaggccacaaagtatccagagccacaccacaactatacctacttgtaaaatgtgatactggagtagagtattcttgtccttctacttacccaacagctagcaaatcaggacaggcaacccagattctggagttcagccaaagtagttc

SEQ ID NO: 45032 - DNA, 1016 bp, Homo sapiens
gtcctggtttagatataggtatatagagagagctatttgagtaatcaattcccaatatggtatgatttgagcatttggagaggtcttctttacatatcatagtacttagattattaccaataaatatttttcttttggggttaacattacagtaataatatattttgaatctaaaatttggatggagacacaggacacagaatatataatgctcaaaaaatgtaatgctcaatgaatgtctctatcatattcttttttgttgttgttgttgttatatagatgaggccttcctatattgtccaggctggtctcaaacacccagctttgcctccttatgtgccaggaaaacaggcctgagccaccaagactctcaatatattattaaaatataaacaaattacttgaagtggtacccctcaaaataatgtcattttcactttaatgtaaattagtcttactataaaatcactttcctgctttcaacaagttgcaatgtaagacgggacattttctgaaatggagagaagataaacatgaagtaagaagctttgtccccagcaggcttttcctggcagaaaatatggacatctgggtggtgtcatagtcaggaggccaggaggaaggatttgccaaaatgggtaaactgggcagtgcatgaaaactggtgcctttgctcctatgggccatcatcctgttgatagtgaggtaccaagagaagtgctgatggtaaagccctgtgtcctccccatccatgatcttggccgaaagcattaacctccgaagagtctcggtgcttttagagacttcctggtctgaagtgactgcctgttgtggacaaaagctgaaaacaaacaacataaaaacaaactaaaaaggtcagttactcaaggatctagacaactagccaacacctccacaaacaaatgggagcttaatagactttgcaaaattactttttatccagttgtttttttttgcttatttaataaagttgaaaatacaatgcagttctgcga

SEQ ID NO: 45033 - DNA, 396 bp, Homo sapiens
cagtacttgctctgttcacttggattattcataatgaatcacagggaagaacccattttattataatactagtgtgggcactgagagataacaggtgcatgaagtgacttggaggccccctaaatggcttccatcccacccaaggaacaagcctggacaaaagcccccaggcctgtgccctggcatctcagagaacctccttaggtcccagtcccaccttccatcctgtcttcccacctcccttgctcaagactgacacctctcgtttcatcctgttgcctcagtcaaattctctttctgacccttgatttcagcctcaccctgggtgtcatccttctgactaactcttcatgtcaagctctgcagtcctgaagccatttcttttcttttcttttt

SEQ ID NO: 45034 - DNA, 320 bp, Homo sapiens
tcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacacacgatgtatgt

SEQ ID NO: 45035 - DNA, 400 bp, Homo sapiens
tttttttttttttttcaaaaaagctctctagctgctacattgagaataaatgtagacatgattatctgctaggagactattgagacttggtgcctgcagtggaatgatagtgagaaatgattctattttggatatgttttaaaaggagaacccacaggatttaccaatagatgtggagttgaggaaaaattatgaattatttagaatattttttgcccaggcaattgaaacaatggacttgccttcaactgagatgaggaaggtagtatatatagcaggttttggatgagatgatatttagaatccatctagtgcacattaagcttcagatgcctttaaaactcttagaagaaaacacaggggtaagtcatcacgaccttggatttgacaatggtttctc

SEQ ID NO: 45036 - DNA, 650 bp, Homo sapiens
gtgcatctctcttcaaagatcactttgcattgagatgtcaggaaagcgtgacagctggatgaagcacctaccccagtttgcaagcaggtgggttttcggttttctggaccctcttacccagctcccagatggccatgcatttgaaaatcgccaattaggcactttgcagtcacctggagtttttctattgagacatgtttcaatctcattaaaaaaaaaatgttgcccaccttcctccactctcatcagaaaagaaatttattaacatgcaatgagaactttaaaaaactcatccagaagctttctttctgaggagtccagcctgaggtgataatccagaaatgtggggatgtataggaatgtttattgaaactttaaaggaaatttttcttttgtggcaaaatatatgtaacatgaaaacaatttaatagtaggaaactggaagcaagtaaatatcgagcattagggaatatgatattcccatgtattcaaatataatacattctttgaaaatactttcaaagaacttttaatagcaggaaatttctcttgacatatcatgagtgaagaaagcaggctccagacctccaattaggtctttagatttcagatttcaggcacatgcattgaaacaagataaataaaggaac

SEQ ID NO: 45037 - DNA, 728 bp, Homo sapiens
aagaataaagctgctatcaacatgtgtatatatgtttttgtgtggaaaagttttcttttggtaaatatctaggggtagaactgtgtcttatgtatatttttaactttataagaaactgctgaacagttttctgaagtggttgttccattttgcatctccacctacactgaataattttctctctgtattcttaccaacacttggcattgttggtctttttcatgttagcccttctagtgggtatatagtagttttaattttcatttcttaatggttagtgatgttgaacatcttttcatatgtttattggctgtttctgatcttatgtatatcttttattggctaattgtttatttgttaacatcttttgctcataaattaggctctttgtcctattaccaattggtaatattctgtataccaatcctttgtgagatatatgtattgcaaatacgttttcccagtgtgcagcctgcctttttatttttttttgtggtgtctttcaaaatgtctttcaacttgaatgaagtccagttatatcatgttgttttgagaccactttagtaatcctctgtagtttctttgtttctctgaagatcacgtattcccagcacattgtgtatttcatactatatatgtggaatcagccattttcctcaaaaaacttggttccttttactgagagtacttgaaagcttttaccgctagattagtcattgtctttgggg

SEQ ID NO: 45038 - DNA, 904 bp, Homo sapiens
gggattacaggcgtgagccaccgagcccggctaggagttggcttttaatctccaggacctctttgccctgggaataaaatcccttttcctgtgccaccaggcctccccagctggccccagccttggttcccactaccttccccaagctctggccatctggccatctcgatggcctctccagcctctgacataagagagcctgcttattcttgcctcaaggcctttgcctgtgctgttccctctgcccacagtgcccttccttgtggtctgtgtgtggctggcacctcacctttcagagcttagctcagaagtctcctctaggggaggccctgtgatccctgatcccctgcagaaagcccacctgctgccccagcctgcacggttttcttcacagcctctgccacaatctggaaattattgggttcatttacttgtttccttgttaatgtctcccactcccccacctacacgcatgagaacgtgaacccctgagagtcgtaaccttatctgtcttctttgggttatgttcccggaacctagaaaggtgccaggcacacagcggatgttcagtaggatggtaaacaaataaagcttctttaggctgatgaaaaaactgagggtcaggcgcggtggctcacgcctgcaattccaacactttgtttgggaggctgagacaagcagataacttgagtctgggagttcacgaccagcctggtcaacatggcaaaccccgtcaatacaaaaaatacaaaaattagccatgtgtggtggtgtgcgcctataatcccagctactcgggaggctcagaattacctgagcctgagcgcttgagactgcagtgtgccatgatcgcgccgctgcactccagcctgggcagcacagtgaaaccctgtctcaaaaaaaa

SEQ ID NO: 45039 - DNA, 538 bp, Homo sapiens
gtacttggagcccaccgtatcttcccatatgttcccatttcaggattcagggtctcactttttccaaacaatgttctagcttcacataaggtatcctaaaaacctgtgaattcaaatgatgtcttaacttagcaaactaaacagtcaattatctctctctctcccagttcaacagtttcaagacatatttctttagaaaattccaaagagcccctgatttggggatttgtgtttgttttaaaatatgtccacaaattggccaggctggtggctcacacctgtaatcccagcactttggtgtgccaaaggcgggtggatcatgaggtcaggcgatcaagaccatcctggctaacacggtgaaactccatctctactaaaaaatacaaaaaattagctgggcatggtggcaggcaactgtagtcccagctactcgggaggctgaggcaggagaatgtcctgaacccaggaggcagagcttgcagtgagccgagataacaccactgcactccagcctgggcgacagagcaagactctgttt

SEQ ID NO: 45040 - DNA, 434 bp, Homo sapiens
gtgtgtgcccgtaatcccagctacttgggaggctaaggaaggagaatcgcttgaacccaggaggtggaggttgcactcaaccgagatcgcggctttgcatcccagcctgggtgacagagccagactccatctcaaaaaaaaaaaaaaagagaattccactaaacacctaacatttaaaagagtaataacacaacattagtgaggatgtgaagcaacaacaaaaataaactttacaaaactaaagacaataacctattattcatttttatttttctttatcttagaagaatcttccaggaactaatattacttgggttagaaaacttttatgagaacttatccggttccttcagcacttcattggtttcttttcttttgttgatgtctagtgcatgaaatttaattttcttcaataaaaagatggtgatgtgtat

SEQ ID NO: 45041 - DNA, 297 bp, Homo sapiens
ataaaatcatgtattttgcaataacagagatggacctggagaccactgtcttaagtgaaataacttaggaaatcaaatactacatgttttcactttaaacaatgtgtacacaggaacatacattgtggaataatgcacattggagactcagaagggtgggatgggaataagggatgagaaattacttaatagatacaatgtacactatttgggtgattgctacactaaaagcccagacctcacactattcaatatatccatgtaagaaactgcagttttaccctctaaatctataca

SEQ ID NO: 45042 - DNA, 693 bp, Homo sapiens
cataaataggtaaatctgggtaaagggtatatatatgccatttttaaaagtttgaaattatatttagctaaaaggttcacctaaaaatgcctacatagcaaaatcactttggctaaggcaacagcaaagggttagcccagaatttctcccattaaattttctgtttatttgtgttttgcccccaagggcatagacatataaactttaatattttcaactcttctaacatttaaatttcttatttcattttcttatctaattgctttagctatgcttcccaaataatgctaaataataatggtgatacctgatattcttgctgatgaatttaatgagaatgcttcaccaataaggatgacttgtatttgagatacagtcagtcattttaaattgagtatcaaatacaacactagtctgggattacaggtgcctgccaccacacccagataatttttgtatttttagtagaaacgaggtttcaccatgttgaacaagttggtctcgaactcctgacttcaggtgatccacctgccagcctcccaaagtactgggattacaggcatgaaccaccacgcccagcctaactggcttcttaatggtgcatagttgtttctaatcttttcttgtaacagatattaaaatctcctcatccatacttctttgcacacgtgtgcaagtaggatacattcctgg

SEQ ID NO: 45043 - DNA, 401 bp, Homo sapiens
tcttttccagaaggagttttgatcttgttgcccaggctggagtgcaatggcgcgatctcagctcaccgcaacctcccacctgcagggttccagcgattctcctgcctcagcctcccgagtagctgggattacaggtgcctgccaccacacccagataatttttgtatttttagtagaaacgaggtttcaccatgttgaacaagttggtctcgaactcctgacttcaggtgatccacctgccagcctcccaaagtactgggattacaggcatgaaccaccacgcccagcctaactggcttcttaatggtgcatagttgtttctaatcttttcttgtaacagatattaaaatctcctcatccatacttctttgcacacgtgtgcaagtaggatacattcctgg

SEQ ID NO: 45044 - DNA, 395 bp, Homo sapiens
cagttagtccagataggagtgaaataacagagggctttaagtaggaacaatctgggagacatcagcaaaatggtagactaggaagctccaggcccttgttaccccatggagacaccgaattaacaaccatatacagaccagaatatcactgtgagaactctagagccgaattaagaagcttcagtgcccaggccaatgcctaaccaagaacataatctatcaaaagtgctaggaaagtttgtggcattttgcgcgccaacatccctctccctcccctgcaaagcatagttcaactaggagaaaacctcccataccttggctcttcccttgggccagaaacaaagagtggaccatgcatgcaatgtactgacttgtctggggggggggggggctaa

SEQ ID NO: 45045 - DNA, 399 bp, Homo sapiens
catgccaccatccacacagaaaattgtaactgaaaagcataccagtgtaagcaggtgagtcttggccatgtaggtgaccagtcctgaggtcccctctcctttgccaccctgcaaaggctcaacattcaggccacacctgtacctatatgcatcatactggtgttcagtggtatgctggtcaggatgctctcccctgtatgacttcttagaatcttgtttgatctgactctagagtatttggccacagtgatttttacagtttccagcaatcacctgagtatttcatgttcttgaagtccctctgatgaagtagcaaaaggtttctgaatgcagtaatcctagttcagagcttacttgctatttgctaaggcttgttatgtgctgccattttgaccatga

SEQ ID NO: 45046 - DNA, 788 bp, Homo sapiens
tgagacagggtctcactctgttgcccaggctggagtgcagtggtgtgatcacatatcactgcagtctcagcctccagggctcaaggaattgccccccacgtagctgggactattggtgcatgccaccacacccagctaatttttgtattttttgtagagacagggtcttgctatgttgcccaggctgatctcaaactcctggactcaagcaatccacctgcctcagcctcccagagtgctaagattacaggcatgacccactgtgcctggccccacctgcctctttgtctgtacttctgtgatcagaagcagcactcagtgaccacagcatggatcccattatttggaggaaaggttcctctttgctcaccctggctcctataagctgtgtgcaagtttttcggggaaacatatgcacagctgcttgtcatgggcttggttggcagggaagaatggagcagctgttactgtgctaaggcctgaaactgactgaaattaactgtactttattgtccaagctgtccctgaaatttgcaagccttcaatagactcctgaactccaaaatagttgtatcagacagattctgcccgtgcaattattgtctaggtaaggagaaaagttcctggtgcttgctactctgccatcttcctacaatcctctctgagagtctatatttttaacaatatcacaagcaattctgatgcaggtcatctgtggaccacaatctgtaagaatgtctcatcaagagggaagctttaaacagggaattactgtcctggaggctctt

SEQ ID NO: 45047 - DNA, 460 bp, Homo sapiens
ggatgtctgcctctactaactgggaggggttaatgtcagagcctatggcaatttgtggagctttctggagctatctggggcactctgacatatgaagtcggtgctgaggaccacctgacacattttgcctcggggtcccaggacatcgagtcctggaggcactttctcagtcattctagaaatgctgacatgttcttatcagttgaacctcccccttagcttacccccattaaaagggggtttgctaatttctttcatttctctcaacaacatattctggggagtgttctaaaggttccctcgctgttcttgacattggggtccacactcaagatgggattgcactgctttttcaccagactcaggatgtctcttcagcctcccagacccagagacagatgttgctgtttgctcagccacctgcaatccaggaagagaggcctcaacagataccaatcct

SEQ ID NO: 45048 - DNA, 868 bp, Homo sapiens
ccttgataattcctctctccctcccaccagcaccataaacagtccataagagttaaaggaaacgaagataaatgcaggaaaagtttacagttgaggggaaatgaactgtacttcacatgcttcattatttagcatatttttttgtgcgattataaaattaataaagaactcagaactttatggatactatccctattaacactcaccccatagtcaagacagtatgagaggcccaaggctttattcagtacagaaagtgacgtagagaaagataccacctctgggaaagacctggcagttcctaccagggaaacacgtaaaccacaacacagccctgacctttgcaacaggctgtctgaaccccgtgaagaacccacccaggagattccttgagctagactttcattcaccacatggcacatagtcttgacccgggtgacagttcgctgtcctaacctgtgtggcctcagatgttgaaagaaatgtttgtcttgttatgtcaggaacacaactgccgaaaaaagcaacataacaacaacaacaacccccacaacctgccttaggtatattccccacttctgtctgtgggcaagcacagagatgggaagacgtgcaatgctacctttaaaattacctctatttctaactatttttttctaaaaactatagcaaagtacagatcactcagactgatgtagcatcattgcaaaggttcaattcacaaatgtattttcatatatttctaccaccctcgaacagcattcttcgaactttacaacacattcagctgacttctttaatgtaaaacgttaaatggggaggaagtacagtggagcgagactcagggacctcaaaagacctgggttct

SEQ ID NO: 45049 - DNA, 351 bp, Homo sapiens
caaatgagggtgctaatgatatgtatcccaagggtttgatgtgagaattaaatgagaccaggcacatattgctttgcatttacactgtggtattgttgatattattagttatctgtgttgatagttgtgagcatccttccagacattggcacaatgcggtgcacgcagctggtgcttggtgactgcaaatggattgacggacagggcccagtatctgggctgggtgtgggtggctcacacctgtaatcctagcactttgggagaatgaggcaggaggattgcttgagcccaggagtttgaaaccagcctgagtttgaaaccagcctgggtataagcaagacctctactaaa

SEQ ID NO: 45050 - DNA, 342 bp, Homo sapiens
acagggttgggataggtggttggcatccacgaagggatgagtgacttccttaagtgaagtaggccttgaacttcacagaatttatgaaaagtgaattctaaaggtggaagggagggggaatgattaaagccttaaagttctcaaggaaaaggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacata

SEQ ID NO: 45051 - DNA, 168 bp, Homo sapiens
atagaaactttcaataaactagaaatagaaggaaatttcctcattcagataaaaataatctatgaaaactctatagctaaaattatatttaatggtgatgcttttcctgtaatattagaagtagtgagagtagacacccttgttttgttcctgatcttacaggaaaag

SEQ ID NO: 45052 - DNA, 309 bp, Homo sapiens
taacagtaacaacgattctttacatttttatagagagcttcaaacattttagactatctttacttctgttttcctgttattcctagtacctctccagattagacaagatgatattaaatatttccatcttacagatgagcaaattccccagacttagagacgataaggtactagccccctggaaaacaactgcactgaacctaggtcctttatttctgaacaagacaggcatcgtgttgaacttcatgaagaagataatctaataattgaaaatacatcaaatacaaggacaaataagagacgctgggg

SEQ ID NO: 45053 - DNA, 522 bp, Homo sapiens
cgtgaacctgggaggcggagcttgcagtgagccgagattgagccaccgcactccagcctgggcaaaagaggaagactccgtctcaaaaaaaacaaaaacaaaaacaaaaaaagaatgcatggagttagttcattcttctcgccccctggaacttctgatcaaaagtcaatacctttgtgacctacaagtctctttatttgccctccattatagactgagctgttaataacatttaatgagctcacatggattcactggctaataaagaagaatagagttgaggacattgctgccctgtttatgcccaaaaattaccctaaactgaaagttgctttgtgttccttcactcccctctgctggtaaattttaatatagttcttaatttttttaagtcaaattgatagaaacatcaattgtgtttttaaaactgtaagaaaaaataatgttgaacatcacaaaaatgtactcaatctttcccaaaacccatttctttccagttagttttcataactgtaggttctt

SEQ ID NO: 45054 - DNA, 240 bp, Homo sapiens
aggaatcatatgattttaagtatggaaaatgggatttattttcattaaattgtttcatgataatttgtttaatgttaaattaaggatgcctttattttgttatttcttatctaattcttattggagttcttcatttgaattgttgttgagtgaataatatttcatcttagaaaagatctgagtgtgaaataaaaagactcattatagtaagaaaaatataaggtatggtattagaacaca

SEQ ID NO: 45055 - DNA, 332 bp, Homo sapiens
tgattgattagtatgatataataacaaagttaaaaagttttcctgtattattgtttgaaattaatgtttatcttgaaaagctctgtgatttaaccaaatatggggattaaaatatgtgaaataattactatgctgaacacattgtagtaattatcttcatttaataatcacaaaactctatgaggctgtttctactattatacccccatttcacagatgaggaaactaaggcttatataagctattaagataaagtgctgggattacgggcgtgagccacagtgcctggcagtactttttccaagcagtggtgtgttaggctccattgggtt

SEQ ID NO: 45056 - DNA, 494 bp, Homo sapiens
ctcttgtcacctaggctggagtacagtggcgtgatcttggctcactgcaacctctgcctcctgggttcaagtgattctcctgcctcagcctcccgagtagctgagataacaggcaccgggcaccacacccagctaatttttgtagttttagtagagacggggtttcaccatgttggccaggctgctctagaactcctgacttcaggtgatccacccgcctcggcctcccaaagggctgggattacaggcatgagccactgcgcctggcctgagctgagaaggaatggagaaaaatggcctctgaagggccccaagtttccctaaaagtaaaatctgctcaaatttaggctgcaccttgattacttggaactgcctgttgttgtcttgcctcatttaaacatgaggaaactgccccaagtgacacatcgtaacccctatttcttcatatctgctatcttctacagacagtcttgcatttgcaaagatgagctatt

SEQ ID NO: 45057 - DNA, 450 bp, Homo sapiens
ccaggggcttatcccaaggggttggtcaccccatgtccattagaagtgcagatcaggaaaggagggtctctgaaggccatcacgcaggtgtcagggaatgaaggcagccagagcggcagtgaaggacacacagcatgctgcccaggagcagtccttgagttgcaaaccacagaacagcttgggactggatgaggcagggtccttgctggagagatggcaggaaactcacaggagggcccgtggctgagaaccaatctgagaaacagaatgagagccaagccaggctggtcctggagctcctggctagggaagctgtggagaaggatgttcttggacctgcccctacactcctgcttctcactgggctccagtggcaaagccctgggaggggtgggagctgggctcagcttggggcctgggcctgcccctagctggggtgagcagcccctc

SEQ ID NO: 45058 - DNA, 306 bp, Homo sapiens
gctcctgctgaggcgactagcacagcccagctgcaactgaagcgttcctttggccccggcctctcctgcaagaaacgctcaagtgcacgcatggacaactcggtcagaggcttgtggatggcgtagaggggcatggacagctgcggcaaacatcgagccatcttccgtcccatgcccaccatatgaccaacagaaggccagccatgccaaaaacctgactgcagttctcaggaaaacttcattctaatgcccaagtgacacggataatcctaatttgtcgacgcggccgcgaatttagtagtagta

SEQ ID NO: 45059 - DNA, 447 bp, Homo sapiens
gtttacttgggaagttagtatcaaggtacgatctaggtctctcattctacttttttcccttttgttgtcttttagcagcaatgttatgttaggttcttgaaaagatttaggaagcttttcttctctaagaagagttttaaaacttttttattggccaggcgtggtggctcatgcctgtaatcccagtactttgggaagccgaggcaggcggatcacgaggtcaggagttggagagcagcctgaccaacatggtgaaaccccatctgtactaaaaacacaaaaattagctgggtgtggtggtacgtgcctgtagtcccagctcctcaggagtctgaggcaggagaatcacttgaacccaggaggcggaggttgcagtaagccaagatcgtgccactgcactccagcctgggcaacagagcgagactctgtctcaaaaaacaaacaaaa

SEQ ID NO: 45060 - DNA, 497 bp, Homo sapiens
gtaaatataaaaattagccgggtgtggtggcatgcatctgtagtcccagctcccagggtgactgaggtgggaggatcgctggaacctgggaggcagaagttgcagtgagctgagattgtgtcactacactctagcctgggtgacagcaagaacctgtctcagaaaaacaaaaacaaataatattgcatctttatatttatttccgtttctcttgggctgtgaatgatgtcatgtactgtctgtgtttgtgtgtgaggttttttggtgttttttttttacatggggtctcactgtcacccagcctggagtgcagtagtgtgatcacagctcactgcagcctcagcttcctaggctcaagcaatcctcccgcctcagcctccagaacagctaggactacaggtgcaccccactgtgctcagctaattttttattttttgtggagatggggtcttgccatgttgcccaagctggtcttgagctcctgacctcaagtgatc

SEQ ID NO: 45061 - DNA, 363 bp, Homo sapiens
tcccttaatggctaccattttttgcatcttattagaaatgttcttcaattgtctgcaaattgattaatgttaacatttctttctcagcttaagaagtcttttcttttgaaaccattgtatgtataattattgatgtcttatgaagctgaatgttaaagaaatctaattgatttacaaataaaaatgatatgggttaataatattcctaagcaggatgccactgctaacaaactgaataatttgtatttttatatatatgtatatatacacacacacaaaataagtattatatgtgtgtagatgtaatcacataatcacgtaatcacagctcactacagcctcgacctcccaggctcaagagat

SEQ ID NO: 45062 - DNA, 3023 bp, Homo sapiens
gggagagcaatgctcagagcccagggatactcactggggcacctcctagtactgctttgcctaatagtcctgggaagtgggaaagtgcagaaattcaataaatacaggattgaagattagggtcactagatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaaaatacttgagataattgttataaatcaggtttcaggtgggcgaatatgattgaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatctgatttagatttttttactggctaggactctgactgaggtgctggtgtgaggcctagaattactgcagctattttgataccattagaatgcacagtcaaggataaagctttcatgtaaggaagggtatagcagagaaaattatagaaaaatgaagcagaatcttaatcaaattgtacttaaagtcagataacttctggatgcaactcactgaagtaagaataggtggatatttcttaaatatgacaaaaatatatacatttctaacaagaagcctttcatgtttaagggataaacactagaagcatttccattaaaattaggaaaaagacaagaatgccagttatttccacaattatttaacattgttctagaagtactagttaatgcagtcaaccaagagaaagaaatgtaatattgatattggaaaggaaggggcaggcaagattatcattaccacaaatgaagcaaatctaagagaatcaactaaagactacttgaaacctttggaactccataaaaaggctggttatgaaatcaatagaataaaaactgatcactttcatatataaaaacaacaaacaaaatgtaaaataagaaaaaaaatctaaattacaatagccatgggaaaagataagctccttttgaataaacttaacaaaaaaatctgtaagacatatccattcattcagtaaatatggattgataacctacagtgtgccaggcaatgttctaggagttatttttatttaaaaaatttagaaactgctgagaaaaataaagacaaataagtagaaaaactgggttgttggatagaaagatattcctgtaaagatgccaattatcactcagttaacttataaattatgtgcaacacaaattgaaattaaaaacggtagtttttaggggactataacaaaataacagattttagtctctaaataaatacatgtgaacaggcaggtaatgataaaaaagatgagttatgagagaccttacccttcagatattgaaacatattatgaagatactatagttaaaacagtttgttatttaagaagaaagaaaagataacagattaaaagaatataataaagaataaagaaatagatacaaacatatgtggatgtttagattatgataattatggtaaagatggcactttattttttattttttgggtattatacatttaatttaaagacttcgaagtaaaaaaaaaaggtacagaaatacagattacattgtgatgaccccagtagtattctacatgacaaaaataaaaacagatttaagtaaatgtatcggcactgaacaagcatttacttaacatccaatccaggctgcatatgcacaaaatgatctgaccacatgcttatgcaaagtagtttttcttagaacgccaaaattccaaccattctgactgtccgctgcgcattcccctgttgagtattttgagcgaacttctatagaatataaaaacaattggcatggcacttaaagactgcaaaaaacagaacacaattaaaaacatttataatgcatttctgtataaaatatacaccataaagaccaccctgaataatggttaaaacctcatcatagaaaaatgctcatcattttgcacattattgatagaaactactgagaggttttcttggggggctggtgggaaggtagacacccaacttaaagattcattcaaaatttgctttaaattgtgggtaataactcactgcttacccctctcaaaatgttttatcatgaatactctaatatttaaccacaggacaaacataaagaataacctgaagaaggtgtttctcaaagtgaagttgaaggctccaaaagaagtctaaggtgggcccactagtgtgcattttaaacaaacttcctaggtgattatttcacattccaaaatctgagaactaatgccctgtgggaaacagcaccacttaaaagcaaggccataacatatttctgacatgagatacagaattctaagtttatgatttgaagtgaatactgctttttgttttaaaacaagtttcagatgttaagagaaacatattaaataaacatgtgcatgtatat

SEQ ID NO: 45063 - DNA, 842 bp, Homo sapiens
atgattctgtcatcaccatctccatggacttccagaatgccttaatcatcatcagagtatcctacacaaagttgtctctgaccaaggaactcatttaatggacaaacataaagaataacctgaagaaggtgtttctcaaagtgaagttgaaggctccaaaagaagtctaaggtgggcccactagtgtgcattttaaacaaacttcctaggtgattatttcacattccaaaatctgagaactaatgccctgtgggaaacagcaccacttaaaagcaaggccataacatatttctgacatgagatacagaattctaagtttatgatttgaagtgaatactgctttttgttttaaaacaagtttcagatgttaagagaaacatattaaataaacatgtgcatgtatataaacattttcctttgaggttttcattgctttcagacttatgttatttgaaggaaagagagtacacagctagaaactttggaaaaatgacatttccaatgaaatgtagcatccacccctccaaaaaaagataatttattaaatgcctacaaattttgaaacatttgaaatttaaactaggacactttcctaaaattaagttttactaagattaaaaaactttaagtaatttagatgatcatggttactttttaagtcccttttcattaaaaaatatttaaaataaacaacagaaggatgctatatttggcacccccttaaataaactgctaaacactaatattaataaaaaataatccaaggaactctgcctctgaaatgtattctactatgtgttacatgtgttatccagttaataaaaactcactgaaagagctga

SEQ ID NO: 45064 - DNA, 3406 bp, Homo sapiens
gggagagcaatgctcagagcccagggatactcactggggcacctcctagtactgctttgcctaatagtcctgggaagtgggaaagtgcagaaattcaataaatacaggattgaagattagggtcactagatcagggaaataattttgaccaggtttctgtaaggggaatatgaaatgggtggtagaagaatgaagttgattattgactttggcctcatgatcagcttcagtgggaaactgtaacagctatgcacatctttgttaatttatttttctcttcctttcctctgattatatgaaattagcattatcccgtgacagtacggtggctgatgggattttttttgtccctgcctccctgttgggagaatagaataacaagaatagatgctgaatgtgaaaggagtgggccatggtggttagtctttattttcccacacatcctgattcatttcctgtccttctctgtcttgttctatgccctgggcggctgatccttagggactgcatcccccagactccatttgtaattgacttctgcttgggtttggtcaatggaatgccctggcacagctttggagggaagaagagagaagacaatgtatttcttcactgctcccactctgatttgggctatgttttattggcagggactgcatcccttcaagattttagcttcttccagaagtcccctcctccatgactctagctctcactaggctccagaaatactatttcttcctcttgccctcttaggcctagggtaacagctacctgctattgctaacctctgggtgccacaaaattgcttgttgggtctcataatcttgcatatacctctgtaagtagtccctacattaaagtcccttgaaccatctgatttagatttttttactggctaggactctgactgaggtgctggtgtgaggcctagaattactgcagctattttgataccattagaatgcacagtcaaggataaagctttcatgtaaggaagggtatagcagagaaaattatagaaaaatgaagcagaatcttaatcaaattgtacttaaagtcagataacttctggatgcaactcactgaagtaagaataggtggatatttcttaaatatgacaaaaatatatacatttctaacaagaagcctttcatgtttaagggataaacactagaagcatttccattaaaattaggaaaaagacaagaatgccagttatttccacaattatttaacattgttctagaagtactagttaatgcagtcaaccaagagaaagaaatgtaatattgatattggaaaggaaggggcaggcaagattatcattaccacaaatgaagcaaatctaagagaatcaactaaagactacttgaaacctttggaactccataaaaaggctggttatgaaatcaatagaataaaaactgatcactttcatatataaaaacaacaaacaaaatgtaaaataagaaaaaaaatctaaattacaatagccatgggaaaagataagctccttttgaataaacttaacaaaaaaatctgtaagacatatccattcattcagtaaatatggattgataacctacagtgtgccaggcaatgttctaggagttatttttatttaaaaaatttagaaactgctgagaaaaataaagacaaataagtagaaaaactgggttgttggatagaaagatattcctgtaaagatgccaattatcactcagttaacttataaattatgtgcaacacaaattgaaattaaaaacggtagtttttaggggactataacaaaataacagattttagtctctaaataaatacatgtgaacaggcaggtaatgataaaaaagatgagttatgagagaccttacccttcagatattgaaacatattatgaagatactatagttaaaacagtttgttatttaagaagaaagaaaagataacagattaaaagaatataataaagaataaagaaatagatacaaacatatgtggatgtttagattatgataattatggtaaagatggcactttattttttattttttgggtattatacatttaatttaaagacttcgaagtaaaaaaaaaaggtacagaaatacagattacattgtgatgaccccagtagtattctacatgacaaaaataaaaacagatttaagtaaatgtatcggcactgaacaagcatttacttaacatccaatccaggctgcatatgcacaaaatgatctgaccacatgcttatgcaaagtagtttttcttagaacgccaaaattccaaccattctgactgtccgctgcgcattcccctgttgagtattttgagcgaacttctatagaatataaaaacaattggcatggcacttaaagactgcaaaaaacagaacacaattaaaaacatttataatgcatttctgtataaaatatacaccataaagaccaccctgaataatggttaaaacctcatcatagaaaaatgctcatcattttgcacattattgatagaaactactgagaggttttcttggggggctggtgggaaggtagacacccaacttaaagattcattcaaaatttgctttaaattgtgggtaataactcactgcttacccctctcaaaatgttttatcatgaatactctaatatttaaccacaggacaaacataaagaataacctgaagaaggtgtttctcaaagtgaagttgaaggctccaaaagaagtctaaggtgggcccactagtgtgcattttaaacaaacttcctaggtgattatttcacattccaaaatctgagaactaatgccctgtgggaaacagcaccacttaaaagcaaggccataacatatttctgacatgagatacagaattctaagtttatgatttgaagtgaatactgctttttgttttaaaacaagtttcagatgttaagagaaacatattaaataaacatgtgcatgtatataaacattttcctttgaggttttcattgctttcagacttatgttatttgaaggaaagagagtacacagctagaaactttggaaaaatgacatttccaatgaaatgtagcatccacccctccaaaaaaagataatttattaaatgcctacaaattttgaaacatttgaaatttaaactaggacactttcctaaaattaagttttactaagattaaaaaactttaagtaatttagatgatcatggttactttttaagtcccttttcattaaaaaatatttaaaataaacaacagaaggatgctatatttggcacccccttaaataaactgctaaacactaatattaataaaaaataatccaaggaactctgcctctgaaatgtattctactatgtgttacatgtgttatccagttaataaaaactcactgaaagagctga

SEQ ID NO: 45065 - DNA, 671 bp, Homo sapiens
  misc_feature (652)..(652): n is a, c, g, or t
ctgtttttttgcatccgtccatcaggatactcttagcaatgcttgagcatacttggtagccgactccaagcagtgcaagaaagtgcagtcacttttattttatcctggagttatctgccttagtcctcatccctatggaagtctcttccctggctgtgaactgcctcatttgattccctggatttttagtctctgttgctgcccccaggctacacatcagatgagtgcccttgaccttgaaggatgggaagaccacagcagttgagcttcaatgacccccattgccacttcactctccaagctggccattgcttttcataaagcaccgcaaaacttagtgtctttaaaaacaacactaaatcacattgttctcaaatcgagcgttcttagggttcaggtcatcagctcaccccagggaaatgttggacaactgagtctgcagccatctgtacaatgatgaaaccaaggttgagcatcttgggaggagtgtggggtagaaaggtaaaacacagttcctggttggattaaggaaggcacacggtgacaggatttggcagcccactggggatgtctggccatgtctaaggtttggaagatgacaattcttttttttttttttatagtattttattttattttattttattatttnagtaacttctttttttaaa

SEQ ID NO: 45066 - DNA, 2111 bp, Homo sapiens
ggcacgaggctagccttccatggcatcctgctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagccca

SEQ ID NO: 45067 - DNA, 2070 bp, Homo sapiens
  misc_feature (8)..(9): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagccca

SEQ ID NO: 45068 - DNA, 2269 bp, Homo sapiens
  misc_feature (8)..(9): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagcccaaaaaaaacaaaacaactaaaaacaagaaacacaaaaaaaggg

SEQ ID NO: 45069 - DNA, 2546 bp, Homo sapiens
  misc_feature (8)..(9): n is a, c, g, or t
  misc_feature (2354)..(2354): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagcccaaaaaaaaaaaaaaaaaaaaaaaaaattttgtggggcgcggctcgggccctgaaaaatttttaaaacacaatggttggggcgcgcggccccagtagggtaaagtcgaaatgtgggcctaaagctggcncccaagagaaaaccccgggccactggcagtcagtggctggcgttctctccaccaattaaaaaacacgccgggggacacaccgagcgtgttctggcaacaaaatcccagaggcgagtcgcgaggccataaggggctcctacacaacgaggagtccaaagggaagctccactatcaatttcaggccgcgttgtc

SEQ ID NO: 45070 - DNA, 2062 bp, Homo sapiens
  misc_feature (8)..(9): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagccca

SEQ ID NO: 45071 - DNA, 2227 bp, Homo sapiens
  misc_feature (8)..(9): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagccca

SEQ ID NO: 45072 - DNA, 2416 bp, Homo sapiens
  misc_feature (8)..(9): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaagagcctgggcctggtcctgagagaaggttgctacccacgtgttgagagaatgtgcgtgcgccacctcagctgcgccccgtggacattagcgaatgtttgaggagtgagttattcagtagatggagagaggccctcaaagttggctagaagataaatgactaaaaggaaagcctgtttttctcattcttaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttcaaaaaggaaaccaacatccagctcttcgtggggctcaaggtgcacttgtccactggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagccca

SEQ ID NO: 45073 - DNA, 2172 bp, Homo sapiens
  misc_feature (8)..(9): n is a, c, g, or t
ccgggtanngatatcgtcgacccacgcgctccggtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagttccgaggtgcaccgattatacccgtggcggccaagccggggggaccagaggcccccgaaactgaagctccacagggcattccagagctcattgagctcctgacgtcccagatttccatcccaacgagagacccctcgggaccgttcctcatgtctgtggaccactgtttctccatcaaaggccaaggcactgtgatgacagggaccatcctttcaggctccatcagcctcggtgacagtgtggagatccctgccctcaaggtggtgaagaaggtgaagtccatgcagatgttccacatgcccatcacttcagccatgcaaggagaccggctgggcatctgcgtcacccagtttgaccctaagctgctggagcgcgggttggtgtgtgcccccgagtccctgcacactgtccatgcggccctcatctctgtggaaaagataccgtatttccgggggcccctgcaaaccaaggccaagttccacattacagtgggccatgaaacagtcatgggccggttgatgttcttcagtcctgctccagataactttgaccaggagcctatactggactctttcaacttctctcaagaataccttttccaggagcagtacctgtccaaggatttgacaccagcagtgacagacaatgatgaggccgacaagaaggccggccaggccacagagggccattgtcctcggcagcagtgggccctggtggagtttgagaagcccgtcacctgccctcggctgtgcctggtgattggctccaggctagatgcggacattcacaccaacacgtgccggctagccttccatggcatcctgctccacgggctagaggacaggaactacgccgacagcttcctgcccaggctgaaggtgtacaagctgaagcacaagcatggccttgtggagcgggcgatggatgactacagtgtgatcggccgctccctgttggggaactgggcatcatcgacagtgccttcggccagagcggcaagttcaagatccacatcccaggtggcctcagccccgagtccaagaagatcctgacacccgccctcaagaagcgggcccgggctggccgtggggaggccaccaggcaggaggagagcgccgagcggagcgagccctcacagcatgtggtgctcagcctgactttcaagcgttatgtcttcgacacccacaagcgcatggttcagtctccctgagtgtccggtgacctcccccagggcctccttgcccagcccagtccaggctgctgtgccaaatcccaaccagccacgcctcagcctctcccagtctctccctgcagtcctgcagcagcagcccccacccccaagcttggtgctgagccctggtgaggagctgagggggatgggttgctggggccaggagggtctctcctccagcccctgcacactcccacccaggacagcccccagcccaactaggaaagggccatgggcagagggctggtagccagtatcttccactgccccatctgttggccacctgcaggccagtctcaaccctcccccaggtgggcaggcacttgatggctacaaataaatgtcccgtggccccagccca

SEQ ID NO: 45074 - DNA, 337 bp, Homo sapiens
tctgcgatgctgacctaaccgtgacctcttaacctttattagctcatcagaagagctactactgggcaaaaatagctgtggcttccggaaacttttattgaaactctaaatctcctggcaataactttcaaaagtcatgattcaggccagcagtgatatttgaaaatggaatcacaagcaagtctcctggctacaaagatgctcttgctgccaaaaaggaatgctcagctttgacatttatgacaatctgtgtttttcctgttacttagtcttttgccatcattgactgtggaaaggcactgaccctcgttctgtcctccctggagaattctctcct

SEQ ID NO: 45075 - DNA, 360 bp, Homo sapiens
ggactggactctggacttcttgtgtgccactctcccacactttttcctttcctagcacttgtgttctgcaaaggataaggcaatctccagaagtaaggaattgatggctactccttagattggaatggagaaaattctgcagctaaggtcttgtcgccttaactctaaaaccaagccagtgctaagccagtggccttaaaaatttaactttgaatctctgccttgacttcctcttcccagcaacattgtggcacttaataccattccagaatcttagagtttgataagacccctggacacgtggtccaaccattcacataattggaattatccctaccatctccctgacaggccaaagag

SEQ ID NO: 45076 - DNA, 386 bp, Homo sapiens
ctttaatatatagctataaggtatttcataaactctatttaagacatcatattatgctatgcactaccaagaaagaaagatgccagtcaattgtaagatgccattaactgtaaaatgcatccggatttcagatatgtaaaaatttaaaataagcaccttaaaatcaatgaaatatcgcatgtactacctcctgttttctggtatgcatggttaagctctgaaaacattttcactgatggcatgagttttagattgtgtgctaaagtactttaattcatttaacttgtttccacttctcctaaatattataaaaggttcaggagatatgaatattagtaagataaatattttacttcttacacacatacatgggtgctagattgtgg

SEQ ID NO: 45077 - DNA, 346 bp, Homo sapiens
gtttggtggtgttggtggtttttgttgttgttgttgttgttttttactgtagaaatacccatttctcttagcaacatttattgaaaggaccatccttatttctctgcagcaccgtctttgtctaatttaagtgtctgtatatatgtgggtccatttctagactctgttttgttccattggtctatttttctacctacccttgtgccagtctttgttttacccctagccttatactttaagtcttgatagagtcagtcatcccactttctcatttctcttcaggactgtcttgtatcttggccttttgcattttcatataatttttagatcaacttgtcaatttcca

SEQ ID NO: 45078 - DNA, 379 bp, Homo sapiens
ctttaggaggccaatctggcctgtttctttgcttcacaccctctcattccacttcactgcttcctctttctcctctagacagcttaccatgagagcgtccagggttcagtgctcctagcttgtcttattttcttatttttttgttgtttttgtttttcttttcttttttctttcttttttttttttttttttttttttgagacagagtctcattctgtcaccctggctggagtgcagtggcatgatcttggctcactgcaacctctgcctcccgggttcaagcgattctcctgcctcagtctcctgagtagctgggattacaggcatgcaccaccatgcctggctaatttttgtatttttagtagagatggggtttcac

SEQ ID NO: 45079 - DNA, 224 bp, Homo sapiens
caatgcatctttacacctcctttcaaggatgggcatctcagatactagacttggattcaagcagaaagccaccctgggatgacatgccacagaactaagagcctcccttttggacccttcattcctgagccacacaggcactggtcagtgcttcgtgggtccagcgcacaccaccctcaactgtgctccgtgttgctaggccccaagggtgggggtgggaaggg

SEQ ID NO: 45080 - DNA, 427 bp, Homo sapiens
gcttgaatccaggaggtggagtttgcagtgagacgagatcacgccattgcactccagcctcggctacaagagcaaaacttcgtctccaaaataaaaaataaaataaaataaaataaataagagaaaaaatcattcacatttccaaaatcaaattatttatttcttctttctaaaatatacagtttttgttgttactggtttgtctcacatagttgtagaacatcatttttgaaacacagtttcctttatttggaattttgttatgttgaactttctacttttattagctgccaataaaaaatggcaattgggccaggcacagtggctcatgcctgtaatcccaacactttgggagatcaaagtgtaaggattgcttgagcccgagagttcaagacaagcctaagcaacatggcagaaccttgtctct

SEQ ID NO: 45081 - DNA, 429 bp, Homo sapiens
gagaggactcatatataaattaatataagttcagttgatagtcttgatgtaataatattataattgacaacttaataatggttgttttccagaataatggacaattggtgtaaaaattatatataaatagtttgggcttccagatatattaataaacattgatcactcaccagcttggtggagctaaagtggtttcatgactcagctctgaaattggtaagttgtgtaaccttaaaagctgcccaactgctctgtgcctcagtttcctcatctgtaaagcagagatagtaatagtacttacttcgtggggatattgaggacattaaatgagctacaacatgtaaatcacttagaaaatggtaagtgctcaataatgtcagttattatattttttctttatggttaaaattaaaagatgaaatgagatca

SEQ ID NO: 45082 - DNA, 449 bp, Homo sapiens
gcaatccatctgcctctcagttctaagggggtaattattgcctcaactaagcaaagaggaatgcacggcatgctgcctaacccatgtcaggtgactgatgtatgtgccctgacacactcacctaggtcatcggcttttctaacagtggctagggtcatggtacagtaacaaacacaattcactacttacagaaaagggggagaaaaatggatagaggctacattcaatgggccaaacccagaacacaaaccaacaatgtgggctttatcacttcttgtgttaaaaacaagaaacatgggggagaaaagacaggttgactttatgccaaaacgctggtttaaacaaacaaacaaacaaacaaaaaactttttttttaaaaggggacaggaaaggaggtgttttgtttctattaacttcctattaactgtaacttccttacgtatttttaa

SEQ ID NO: 45083 - DNA, 83 bp, Homo sapiens
gactacagccgggcaaatcccacccacccagccagagaaactaagtgtaaaaagaaaggaaaaaatataaaaagggaaatcag

SEQ ID NO: 45084 - DNA, 437 bp, Homo sapiens
ggatacataaattctcatgtaggtatcagtcccttatcatctctgtgctttgtcatcactaaataagtaacataatatttggtcctttcaaatctgtgtttttagatgtatttctgcatgttattgacattgttcttcctcttctaacccactaatccattaaatattcagctcctcctaaattatacattttttgtcctctatagatatatttttaaatttcccttctcaaaataagcttgcattttgaagtacatttgttagaaacaaggtagaataattctactttctagtctcaaggaacagtcttctaaatgtaaagaatagaacctggtggaagtatatactatgtgctatttcactgggtacatattagtttatctgtttagagacctataatcaaccactagcagggaaacttgccttactccatttct

SEQ ID NO: 45085 - DNA, 533 bp, Homo sapiens
caagagaggtctgaacgaacgatgattggagtccccaagatatatctgacaacctttctagcttgagtgacgccattgttcaaaaagaatatcccagagttttcttcccagttctcccctctttaccccattttgtttctttctctgcctcttcagctgtctcttttttctcctttatttctccaatagctctacttcctgctctcctccttcaaggtttcattgctcctcagtttttcccctgattttggttttttttgggactggtatctttcattcttaaacctggcacaaggtaaggaaacaaaagctacgattcgggaagcggtagggcgaaaaattgtaacaccccaagacagattcctcgcccggttattccttcatttcttcattccttcatcaaatatttattcagcgtatgttctctgtaggtcctggcctcatgaaacttgcattactgtggggcaagatgcaaagtaataaataagtaaaatatatataaagtatttcagatgataatatatgctgtagtt

SEQ ID NO: 45086 - DNA, 646 bp, Homo sapiens
cctgaggggagtgggagggcccgagaatctgagggggcccggggaagcttggcctgggctgccgtcttacatctcagtgtgacatgagtgtcagtaatagccaggccccactggggctctgtgggcctgaggggctcgatctgggacaaggctgatgacaccttccacctccacccagttaaggagagtcactgggattcacatggaaagaaaccttatacactgtgtacagtgggggtcttcatccttgatggtaggggagctagcaaagcctttttctcccccttcaggctgcaggtgccaaccaaggcagtcttggaggcatcctgcttctgtgctggttgggatgccttttcataccaccaaggctgctgaaataggtgagaatgacacttctcacccccactgggaagatacatctatttcccccgctaggttgtcacttcccaggaggtagcgcccctcttctttcatctccataccccccacaacttcccacacagtagtgctgcttgcgagataaaaaccaaacttagaacttgtaacaacaggaaggttctaagcttgagctatgcaatagaaaaatttgcaagccacatttctaactttgcattccagcctgggcaatagagtgagacttcatctc

SEQ ID NO: 45087 - DNA, 365 bp, Homo sapiens
aatgagaggattttagggaatgtgtctaacctgcagcagtggaaccagggggaactgtgtcgttctataacagatcccttggtgtctttgttatagccagaattcagggttggatgaaccatattttcggacccattgtgatattttatttttcttgttctgttaatctggaatgttaggtgttaaaaggaagatggtagttgtaaaactagcaagacattttctaggactcctgactggtggcatgtggcatggcaaaaggagatagctcccttttctggctgtaggagacaacttctcaaggcccagaaagccagcatggccccaggagccaccttgaggaatggaggcccacatgagctacc

SEQ ID NO: 45088 - DNA, 488 bp, Homo sapiens
  misc_feature (397)..(397): n is a, c, g, or t
  misc_feature (488)..(488): n is a, c, g, or t
cattgtaatatcaaggactgaggtgaacaagagttggggagtttaaaataaaagccatcaaaggattaagaagaagagcatttctccttcagtttttcttttcactgcaagttgtagggtaatgttttatcctgtgctatttagttctatttttaatacagcaactaaatgtgaatataatcacttatggcaataattgcagaatttgactccaacagtgcattttttttttaatgttttttttttttattatactctaaaacttaaagtatcataataaaaaaatgtgattaaaaaaaatttaaaatgtgacttaatatttcactaggcatttgagagacaccacaaaattgggagcatgtgcctaaaatccatttaatatcttaggatgtccccngttcaggtgtgatgtgtttattcacccagtccccccttttttttgggaggggggcagtacagagcacatcccgtccttcaactctgtaagn

SEQ ID NO: 45089 - DNA, 492 bp, Homo sapiens
tccaggtaacgcagaacacttgctgactattattactcaggctatggagattcctaccagttagtggacacatattttcctccaatttcttagtcttcaagaatcctagctccatttgataactatgagtagtgctttttgaataacttcttttggagggatgagactgcagcaagctatagttttgttttgttttttagagactgttcctcttttgcccaggctgcagtgcagtggcacagtcatagctcactgcagccttgaacttctggggttcaagcaatcctcctacctcagcctcccaggtagctaggattataggtacatgccaccatgcctggataatttttaaattttttgtagagatgggatctcgctatgttgcccaggctggactcaaactcctgggctcaagcagtcttcctgcctcagccttccaaagtgttggggttacaggcattggctactctgcctggccctagttttgttctt

SEQ ID NO: 45090 - DNA, 382 bp, Homo sapiens
ggtaacagagtgagactctgtctcaaaaaataaaataaataaaataagtatgtttgaatggtttagggatcagatttttgtttttgtttttatctgcatggccagatttgacgctagaagagctggataaagactctagattaagaagggctttgtattctatactaaggaatatcagctctatgccaagagtttttaagggtaatggtaaagtgggcaagtgagagtaggggtaccatatgccctcctaggaaaaaatatcaagccttatgagggtgagaggcaggttttatgaaagtgtgcatgtttcctcttctccaaggagttcagatatggtccctcccccacattttactcctccccacccccaacaaaaaaaaaa

SEQ ID NO: 45091 - DNA, 414 bp, Homo sapiens
attaaatcctacttttactaaacaggtaaaaaacaaaatttaacatatgctatttatgagaaacctccctaagagagaatggcacagaaaagttgagattagatagatgaagtgtgtgtgtgtgagcgtgtgtgtgtgtgtgtatgcatttatcagatagatgtgctaaaactagaaaaattaagaagtattttaggtaaaaagtaataataaaatattttgtgttcattgtaatcctccaagaaaatacaattgttacaaaccattaaaccatgcacttttgtaatttataaagcagaaaacaatacaaatactaggagaaattgtcaaagccataatcatagtatattttaacatgcacatcagaaatggacaaatcagagagtaaggttaaataggtatagatacatacag

SEQ ID NO: 45092 - DNA, 419 bp, Homo sapiens
aagccaagcttggagggtggcagagacgtgattgagtatgaaggaggggtgagggcattccaagactgagagttcacctgggtgaaagagcaaggtgagaatcagtccaggcagaacagggcttgtgagtgagggtccccagcaggagcagaaggtatatcccatgaaatgatgagaaacggtggcatgatgtcagagcaaaaagctggggggttcatcagagataagatgctcatgcctaggagactggctttcactcatgagaagttctgataggtactaggaaagacagggactggacacagcttcaaagcccccattcagaggtcctgatggtcccagactccgggagctgcaccctgcatgtgccccactaggcagggatgaggagatctaagttcagccacaccttctatgca

SEQ ID NO: 45093 - DNA, 855 bp, Homo sapiens
cccctctgagtcccaaatctatatcttacagctcttgaaacaccatcctgtttctcactaggaggatcagtttatgttaataattaagaacttagactccagggccagaaaaattgcaaattctttcactcactagctgccatggatacatttcttcacttctctaaggccaagttttacaaagtaaacataataatggtaattactatataggatgttgattgtatttaatgaaataatgcatataattattttagcatagtgcctgctacatagcaaatgccttaaaattgattattattgttgttgttgctgttgttattaatattattatttaaccataaatgttatataactctgttttttaagttaggcattgagattttgtctgccaagaaaaatgactctgggtcattaaggttaaaatgtttaacatgaatataatgttattaatacacttttctcataggatcatcacttctttaaaaaaggaaagccattctgatgcattattctggatctctgtgttaaaagggagtttgggagtgggaggatgggtgggggaactgaacccatcaggtttaactgagaatccattgtaattaaggtgctggggctaagaatagaattgagatatttggactctaatcaatatgtacttaaaagagagaggcctttcaagtggaagagaaaagggtatttgaccagcaattcctctgctaccatgtacactgctccctccaatttctctaacaaaacacacacgtagaaacttcgatgtccaggttacttttactagctattcccagtttgtccagctctcattacaacctaatgcctttttccctgagagat

SEQ ID NO: 45094 - DNA, 447 bp, Homo sapiens
catccacctcatcctcccaaagtgctgggattacaggcatgagccaccgtgcccggctgcatggctcacttttatcactttctaggttctaaccaactgggcataaccacaaataacatccacaaataacatctgacagacagatggggatcagaacatgggctttattcgaggcatggtcacacacaaccccagaggcttctggtaaatgtgctggagaatacagcttaagcctgacgtcagcagggcttcctatgttcttcttccagacctgaaggtggccaggttcacagagcaaacctgaactgatttacctgtccaggcaaaggctggactagaagaagtatagaccagattaggcctgccaggggaacacctccctaatctccttattgcctgaagacagcaggcaaaaagtagaggatagctggcacctttctgcaggcc

SEQ ID NO: 45095 - DNA, 360 bp, Homo sapiens
cagcactttgagaggccgaggcaggcggatcacttgaggtcaggagtttgagacaaacctgaccaacatggtaaaacctggtctctactaaaaatacaaaaattagcccggttcggtggcgcatgcccgtagtcccagttactcgggaggctgagtaatattttattttgttagccctatttcatgcccatttcttatggattaatttaaattccaatatgcaagtggtaataatatggccattggtagtcccttctgtgaatcacagattttacagtaacgtggagaaacaggcatttcttcatcttcgatgtctacttgtttgggagcaatttatcaaggagactgttgaaccatcaa

SEQ ID NO: 45096 - DNA, 453 bp, Homo sapiens
gtccataaagacattagtttacataaatttactcttcatttgcctagctttcaatatttactgagcacctcctatttgccaggcactattctaggcattaggattacagtgtcatggaatggagctgacattctaatagaaggagacctagaataaacaaagataattgtacataatgataaatgagataacacatgtaaaatacttagaacaaaacagtgtaagtaaacactcaattaatattagctgctatccattaattgagtgtttacttacactgttttgttctaagtattttacatgtgttatctcatttacaggtccatgagctacttgggtggctgaggtgggatgatcacctaaccccagcaggtcaaggctgcagtgaggcatgattgtgccactgtactccagcctggccaacagagcaagactccatctcaaaaaatgaaa

SEQ ID NO: 45097 - DNA, 1427 bp, Homo sapiens
ccaaatattctgtattttatacaatatttgtattttaatctggttatagtacataatgtgtacataggtaaaaattcaaggtacacttaagattagtgcacttaacacacttcactgtgtataagtttatattaggttcctatataacctgctgctataacaaattaccacaagctagaagggtagtggcttaaaacaatggaagtttactgttttatagttttggaagtcacaagttctaaatgagtttcaccaatctaaagtcaatgtatcaggagggtcatgctttctctggaggatatagaggagagtctttttgttgccttttctagcttctagaactgcatttcttgcattccctggattatggccccctccctcttcagatccagcgatgtggcatgttcaaatctctttctgcttgtcacattgctttctcctttgtggtaaaatctctccctacatctctcttgttgttgtttgttgttgttgttgttgttgtttgtgttgtttgttttaagagatggggttttctctgtcgcccaggctggagtgcagtggcatgatcataactcactgcatccttgaactcctggcctcaagcagtcctcccaccttggcctcccagagtgctgagattaccagcatgggtcactttgcctggccttctctacatcgcttttaaggacacttcgttattacatttaaggcctacttggataaacagggataatcccccatctcaagatccttaacttaatcacgtctgcaaagtcccatttttcatttaaggtaacatttgcagagtttggtgattagggcctggatatctttgagagccattattcagcctactacagtgttataaccccaataaaatagtaaaataattccacagttcattttgatgagcagccaagaaagagtatcattatcgtgattgtctaatttaaattaaactaatattttaatatctcttttatgtaagagctaatgagctcaagttgagggaaaaattgaggccacatattaagcttcacagccaggatatgttttattactgttagataatcttcaaagagaagcgtgaaaatcttatttcttcaagatcttttaagaacaaaaaaggccttatctcagccgagtgcagtggctcacgcttgtaatcccagcactttggtaggccaaggcaggtggatcacgaggtcagggaattcaagcccagcctagccaagacggtgaaaccccgtctctactaaaaataccaaaattagccaggcatggtggcaggagcctgtaatcctagctactcgggaggctgaggcaggagaatcagttgaaccagggtggcagaggttgcagtgagctgaaatggagccactgcactccagtctgggcgacagagtgagactccatctaaaaaaaaa

SEQ ID NO: 45098 - DNA, 844 bp, Homo sapiens
acctatgttagtaatagtcctgagaacacatacaggaatgagcttttagatttttaaaatccaggttttcttgcattgatttggtcacatctctgatttcacacatgaaggacctgataagtaactgcaataggttgtttacctagtaagtgtcagagttaagacgaaacccccggactcatactttcttgaccagtgcaaagcagcctctccctgatggtgctggcttggaacagcaagaacattctagtatttcttgcagcaaaactgcaaatgtaaatcactagatttcgttaagcagtaaagggaaagagttatggctgttttccatcccaaaaggtcagagatacaagttctagctatagtgcagcagctgcctacaaagacaggacacagaggtggttttcttggtctctgatcttctgttcacctgctgatgactttgccccatgttccttacctgtgctcagtgggcaccactgaggtctctgacttcaggtgggacgaaggtcttgcacctcaggtagctccagactcagctttggctttctcagtccaggaatacagagcatcctcctttgtgctcttctgattatgaatgcaggggatgcatatagtgacaagtggcaagtaactacttgtgtcttctgaagcagaacaaatggagactgatgtgaacagactgcttaagggccgagggaagtgctgggcacggggatggatgagattgacctggggtatcaggaagagtatgccagtgagccctaatacagagcagatgctgggagtttatctgcaaatcggtggttggtgtctacccaatgtagaaggaatttccaggtcc

SEQ ID NO: 45099 - DNA, 466 bp, Homo sapiens
ctacaattcacagtgggcacgagatgaaaatagaatggttgctagggggatactcagcttttcctgctcccgggactggagagaagcttgtgctttggtccccagggaggggccctgtgcaatcacagggacagcgcttacagcatcttctcagtggtgggagtgcacctcatgtgactacattcccctctactttacctcaagctccttgaggggtgtgttcttcatcatatatcagagcccagcacagtgcctgagacatagtaggtgctcataatgtatttttgaatgaatgaatgttatttgtaatttctgtcaatgaaagccaatgggtggatacaagatcaatacacaaaaattaataattttttccatacattagcaatgaaccatctggaaataaaatttctaaaagttccacttataatatcatccaagcaataaaataattaggagtaaatttatc

SEQ ID NO: 45100 - DNA, 473 bp, Homo sapiens
ggtgagatgataggtacccgcttctccaagatgcaaaactatcaaggggcagctctcatcagctcatgaaccttccaacatgctgacctctgaatccaactgttatcctcacccccagggccatggcttactcatgaggccatagaagaatggccacatttgtccattcctgatcctggcagaggcttctgtctttgggagaagtggtcaggctaaggagagagcttcgtattctccaacttggcagggacctttgggatggtctgctagtccccattctctcattacatctcaaattccatcactgactgggttctgggccctaaggctgtttatctaatttgggtgtcagccaatgaccacccaggagccaaatctggtccactgcaggtttttgtaccacccatgaactaaaaatggtttttacatttttaagtagttgaaaaaaataaaaagaagagtaatattttatg

SEQ ID NO: 45101 - DNA, 327 bp, Homo sapiens
tagagatggggtttcaccgtgttagccaggatggtctcgatttcctgacctcgtaatccgcccgcctcggcctcccgaagtgctgggattacaggcgtgacctaccgcgcctggccaaaaatttttaaatttctattacatccctcttgcttaaaactcctaaaaccactcagctttaaggactaactttaagaagttgaaacttaaatatgaggaccttcataatgtggtccttgtctatctttccagcctcttctcctgtcacttttttgcctcttcttttcactctgtcttactggtgtttcctgaatttatcatccctgtcac

SEQ ID NO: 45102 - DNA, 379 bp, Homo sapiens
gttatatgcttaaaagattttgctcattttaaacagaatatttgattaactttggattgcatgtatcaatcaagctggataatagtgtgttacctctagtattaataaaaaaagacaattaaaattattagcaaatactgacataaaaatctgcttgtgttaaaacatagggttaaaccaacagttttaacattgaaatggaaaaattttattatttttgactttgagaaatgcttttatatgacatgctctttttttctttttaaattcaattttattgagtataatttacataccataaaattcacccattttgggtgaatgatttttttaagataattaaccagattgtacaactatcactataaaccagttttag

SEQ ID NO: 45103 - DNA, 635 bp, Homo sapiens
aacttcggtgaacggcggcttaacttctaaagtgatgggaataacgggctgaagctactggtgcccggctgaagtaatcttttaatggtcctcagaaccctattaaataccttccggtattttcctgtttcctcatttgtaaaaacagaataataacagtatgtacttcataggtacataggtacttgataggtatttaatgcttcttgagagcattaagagatgtatttcatggaaagtgtttaatattctgcctggcagtaaagactaaattttcttcccactccagatcttgattcctctccttagagacagcagctgttactggtttcttttatgatgtctctgttgagatattttgatagaaaaagcagtaaaaaatggaaactggcacatttctagattttattgactttcttaagaactttgacagatctgaaattttaccccatttgtaagctaacaagttaacctgcctcagtttcatggatgctggcaggaggcagcatcctgggtcagtaggcagcatgaacttcatgtcagttccctttgacattcatatctcacggtaagggaggagaccacccctcatattgtcttatgcccaatttctgcctccaaaaaaagaagaagta

SEQ ID NO: 45104 - DNA, 1231 bp, Homo sapiens
gaggtggtagccttttgctgctgtaaagcgactcgtgttccctttgtaattaataagtaatctatgggagatatttttgagactgtggctgtgtatcgtgtttcccaacgtgttttcacctgatggtttgattgtttattgagcattgactcctgaccaaactcctcctgaagttcagctgcaggtcaacatcttgacgggcattgaggggacacatttggcaatgtctggagacattttgggttgtcacaacttggggagggtgctactaacatcccaacagaggccacagggatgcagctgaacatccttcaatgcacaggacagcccctgcaacagaattatccaggccaaaatgtcagtggtgctgagattgagaaaccctggattaaacatcacagcacttatgtggtgtttactgtgtgccagacattgttttaagaacttcacagatgtaaagacgaccgtggtttaccctgccacagagaaacacctgcagaagtacctgcgccaggacctccgcctgatccgagagacgggagatgactacaggaacattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcag

SEQ ID NO: 45105 - DNA, 1210 bp, Homo sapiens
agttggggagtcagacagtccatccacctgctgctgtgagggagtgagaagtgaagaggaagcaagctggtggaggagacagaggaccccgaggttagggctgctgttttaccagagctgaccgagcctgaggagctggcctcagagcagaggcctggatgaagcgaggagcagcgtggctcgttgggggacacatttggcaatgtctggagacattttgggttgtcacaacttggggagggtgctactaacatcccaacagaggccacagggatgcagctgaacatccttcaatgcacaggacagcccctgcaacagaattatccaggccaaaatgtcagtggtgctgagattgagaaaccctggattaaacatcacagcacttatgtggtgtttactgtgtgccagacattgttttaagaacttcacagatgtaaagacgaccgtggtttaccctgccacagagaaacacctgcagaagtacctgcgccaggacctccgcctgatccgagagacgggagatgactacaggaacattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcag

SEQ ID NO: 45106 - DNA, 1177 bp, Homo sapiens
ggggctccgcgtccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtgaatgaggcctctgaggatggggatggagaggatgccgttgtgatcctggagaagacgccatttcaggtggaacaggtggctcagctcctgacgggcagccctgagctccaattgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaacattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctcactcag

SEQ ID NO: 45107 - DNA, 823 bp, Homo sapiens
acaagacctggccccatggggcttccagtcctctgaaagagactgtgatagcccaggaaatacacatccagtcacagaatggcaagtcacctgcccaacagaaatgcgggcataggtacggactcatttgagaacctttccctagagctgctgttgtaggtccaatttaatatttgtttgagaggtgattctcaaacatctgacccccacaccacccccagcctctgggctgtgagctccccaagccctgggatgtcttcgtttgcctccgaggcaaacctatatccttagggcctgtgtccacagtccattccatactaatgactatttgtagactaagcgatgaatgaggtgggctgttcttcctgtcttcctgtgactgccccccagtcgttctcacacatgctggaaatgcaggggcacctctgactcttcccagccctccatcctgagctggtcacaagctcatgttgactctatctccaaatccatcaatgtctctctgtttcttgcaccatatctgacatagtacaagtaactttcatcctgccctggaacactcctttagcactccctgtcccttctccatacagctttcagagtgacatattttaattaaaaaaaagaaagatctccattaaagacaagcaatacacaaaacatgcttgtaaacaagtcaagagaatagaagccatagagtaaaaagtaaaagcccgtcttactacctctgtccccatggttagtgcgctgtagatcttccaaagctcctagcctggctcccccgtcgagctccccaggctcttgtcgcatttcctgccacgct

SEQ ID NO: 45108 - DNA, 1082 bp, Homo sapiens
gaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtcctttaaaaaaaaaaaaaatcaatgtttacattgaacaaagctgcttctgtctgtgagtttccatggtgttgacgttccactgccacattagtgtcctcgcttccaacgggttgtcccgggtgcacctcgaagtgccgggtccgtcacccatcgccccttccttcccgactgacttcctctcgtagacttgcagctgtgttcaccataacatttcttgtctgtagtgtgtgatgatgaaattgttacttgtgaatagaatcaggactataaacttcatttttaattgaaaaaaaaagtatatccttaaaataatgtatttatggctcagatgtac

SEQ ID NO: 45109 - DNA, 357 bp, Homo sapiens
atgattaataatagggaataccttttcatctgcttattggccataactatatccttttttgtaaaatgttcatttaagtctattgtccattttaaaattagatttttttggtcattctttatatatcctagatgcaagttcttatcagatatgtgtgttccaaatattttttccagtatgtgctttgacattttattttcttaacaatgacttttgataagcagagttttaatttttataaagttcagtttaacatttttcttgtatatttagtaatttatatgttgtatctaagagtcattttactttaaagtcactaaaatattgtcttatgtatatttagaggagtgttatagt

SEQ ID NO: 45110 - DNA, 2833 bp, Homo sapiens
tgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaaccc

SEQ ID NO: 45111 - DNA, 156 bp, Homo sapiens
gcggccgactactactactactgctcgaattcaagcttctaacgatgtacggggacatgccccgggctctgctggtttggaggggacagggcccttggtttgcacacctcacccgatcttggttataaggtacagtaaaagcgtctgaaaaatgca

SEQ ID NO: 45112 - DNA, 3291 bp, Homo sapiens
tgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaacccaaaaaatgtaaagaaagaattcgacacaatggggttgcgtcacctatagttttcatttcctcaaatgcaactcaaggtgctcagcttgataaagggagagagggagggcaggggagaaactgactcctttttccatctcttttttgcctgcacacttaatgtggactgcctccttggacttaaaaagagggcttgagccaacatgcaaatcaaaaaacatttatgaactgatttcttagctttggacttgacaactgacgaatgctctgggggtgacctggcccttgctgtccgttccactcccatccttgatgatggagacacctgtgtttatgttgtcacttcgcttgccatcctcatgccccgggctctgctggtttggaggggacagggcccttggtttgcacacctcacccgatcttggttataaggtacagtaaaagcgtctgaaaaatgca

SEQ ID NO: 45113 - DNA, 3207 bp, Homo sapiens
tgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaacccaaaaaatgtaaagaaagaattcgacacaatggggttgcgtcacctatagttttcatttcctcaaatgcaactcaaggtgctcagcttgataaagggagagagggagggcaggggagaaactgactcctttttccatctcttttttgcctgcacacttaatgtggactgcctccttggacttaaaaagagggcttgagccaacatgcaaatcaaaaaacatttatgaactgatttcttagctttggactatgcgacctccgccccggctggtcgtgggcacgtacgacagcattgacgccagcgacgcggggttcagcgacttcgagacctccagagacaagagccgccaggcccgcgcggggcaagaaggtgcg

SEQ ID NO: 45114 - DNA, 2451 bp, Homo sapiens
tgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaacccaaaaaatgtaaagaaagaattcgacacaatggggttgcgtcacctatagttttcatttcctcaaatgcaactcaaggtgctcagcttgataaagggagagagggagggcaggggagaaactgactcctttttccatctcttttttgcctgcacacttaatgtggactgcctccttggacttaaaaagagggcttgagccaacatgcaaatcaaaaaacatttatgaactgatttcttagctttggacttgacaactgacgaatgctctgggggtgacctggcccttgctgtccgttccactcccatccttgatgatggagacacctgtgtttatgttgtcacttcgcttgccatcctcatgccccgggctctgctggtttggaggggacagggcccttggtttgcacacctcacccgatcttggttataaggtacagtaaaagcgtctgaaaaatgca

SEQ ID NO: 45115 - DNA, 1300 bp, Homo sapiens
tgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgcccttgctgtccgttccactcccatccttgatgatggagacacctgtgtttatgttgtcacttcgcttgccatcctcatgccccgggctctgctggtttggaggggacagggcccttggtttgcacacctcacccgatcttggttataaggtacagtaaaagcgtctgaaaaatgca

SEQ ID NO: 45116 - DNA, 3346 bp, Homo sapiens
tgtcagtcttccagagtctgggagtgtaagatgagacgggggaaggtgggcctcattctggcggagggcgaggaggaacttcctgcccgcgcgctccacggtgcagagctctaagcgcgcgggctggcaggctgcggcgcgtcaaggtcagcctggagctgggtggcggcctgcctgggggcgggggaccctactggaggcccgggctggggcctcccagcgcctcggccatattgaatagcttcgactggaccgtctttgtctgcgaagtcctgtcccaagttccagccgcgtccctggggcctggggcaggaagagtcgctggcagcccgcgcgccccaacttggagctgggacaccacgtttccagcttggagtgggccttgagccttgggactgacctcgcccccggctcacgtaggcatcctggaaattgattcccccaagtccttggtgggggagccggacttggtcaagactgtacttgttgcaggcgaagagattggaggcgtttggctcgtccctggctagggaggtgagactctccggtcagcgttgctggaactccccccatccagtccctccctcaagactaagggctacagtagtttgttggggctcattgccccctcaccccagatatcaccctggagatcttaaagactctcgagaaaagccacgtggggggctggttcccctggggcttcctgccgtcccccgactgcctcattctttggagcgtccccgatgtctgcaaagatgtggatttggacgtcctcgtggaagccctaaagcccgtggggacatttaagaagatcggcaaggtgttccgcaaggaggaggactccacggtggggatgctgcagatcggggaggacgtcgactatttgctcatcccccgggaggtcaggctggctgggggcgtctggagagtcatctctaagcccgccaccaaggaagcagaatttcgggagcggctgacccagttcctggaagaagagggccgcaccctggaggacgtggcccgcatcatggagaagagcaccccgcacccgccccagccccccaaaaagcccaaggagccccgagtgaggaggagagtgcagcagatggtgactcctccgccccggctggtcgtgggcacgtacgacagcagcaacgccagcgacagcgagttcagcgacttcgagacctccagagacaagagccgccagggcccgcggcggggcaagaaggtgcgcaaaatgcccgtcagctacctgggcagcaagttcctgggaagcgacctggagagtgaggatgatgaggaactggtcgaggccttcctccggcgacaggagaagcagcccagcgcgccgcctgcccgccgccgcgtcaacctgccagtgcccatgtttgaggacaacctggggcctcagctgtccaaagcggacaggtggcgggagtatgtcagccaggtgtcctgggggaagctgaagcggagggtgaagggttgggcgccgagggcgggccccggggtgggcgaggcccggctggcctccaccgcagtggagagcgcaggggtatcatcggcgccagagggcaccagcccgggggatcgcttgggaaacgcgggagatgtttgtgtgccccaggcttcccctaggcgatggaggcccaagatcaactgggcctcctttcggcgccgcaggaaggagcagacagcacccacaggtcagggggcagacatcgaggctgatcaggggggagaggctgcagatagtcaaagggaagaggccatagctgaccagcgggaaggggctgcaggtaatcagagggcaggggccccagctgaccagggggcagaggctgcagataatcagagggaagaggctgcagataatcagagggcaggggccccagctgaggagggggcagaggctgcagataaccagagggaagaggctgcagataatcagagggcagaggccccagctgaccagaggtcacagggcacagataaccacagggaagaggctgcagataatcagagggcggaggccccagctgaccaggggtcagaggttacagataatcaaagggaagaggccgtacatgaccagagggaaagggccccagctgtccagggtgcagataatcagagggcacaggcccgggctggccagagggcagaggctgcacataatcagagggcaggggccccaggtatccaggaagctgaagtctcagctgcccaagggaccacaggaacagctccaggagccagggcccggaaacaggtcaagacagtgaggttccagacccctggacgcttttcgtggttttgcaagcgccggagagccttctggcacactccccggttgccaaccctgcccaagagagtccccagggcaggagaggccaggaacctcagggtgctgagggccgaggccagagcagaagctgagcagggagagcaagaagaccagctgtgaggtgagggctagagacagcccacgggccctccctccaagtgtgggagggagagatgctctgcctctgaacttcaaagtggaggtggagtgctggccacgtctccacctaacaaccctctttattctcttgttaaagttttgttcatgctttgatttttttttaaattttttagagacagggtctcactctgttgcccaggctggagtgcagtggcatgatcataactcactgcagcctcaaacttctggcctcaagtgatcctcctgcctcggcctcccaaaatgctgggattacagatgtgagccaccacacacaccatctgattaaaaaaaaaaaatactgattccttgtagcaacccaaaaaatgtaaagaaagaattcgacacaatggggttgcgtcacctatagttttcatttcctcaaatgcaactcaaggtgctcagcttgataaagggagagagggagggcaggggagaaactgactcctttttccatctcttttttgcctgcacacttaatgtggactgcctccttggacttaaaaagagggcttgagccaacatgcaaatcaaaaaacatttatgaactgatttcttagctttggacttgacaactgacgaatgctctgggggtgacctggcccttgctgtccgttccactcccatccttgatgatggagacacctgtgtttatgttgtcacttcgcttgccatcctcatgccccgggctctgctggtttggaggggacagggcccttggtttgcacacctcacccgatcttggttataaggtacagtaaaagcgtctgaaaaatgcattcaaaacacagattctggggccctcggcaccagaggtgtggatttgctaaaggt

SEQ ID NO: 45117 - DNA, 962 bp, Homo sapiens
aacccttcagtcctaggcaatcactaatctacttgctatagatttgccttttatgggcatttcatatattaataaatagaatcatatataacccgtcctgcgtggcttctttcacttaatgatttcaagatttgtccatgttaaaaactcagtaattgttaggtttttttcttttttttcaccttctgtatcaaaagactaagaacattactgtatattagaaatgtcagagaaaggtatgtttaaggtaatggagaagaaaattttaatgaccaaggaattaggctgttaacatgcagagtagggcttaacattgtctcattattaaaaaataaaagttgatttaaaacaatattgtgtgtaattgtgaagctggtgtctgttgtgtgatcagtggtaaagcacgtgagttgctaggcacaggtgttgagatttcgtgtttgatcagacttctcttttaagtttaagcctggttgaacacaatctctgtcaggtaccgtgggaaatccttaatgtgaaccatttccatgaaaccctcactactgtccagtggtggcgatgctatttattaaccacatttttcaaatgagagaatgggagtttataggcctaagatcagatgccatcccccagacgcctgccttgatgccagtttcctgttgccacccccaccccctcctgttccagtctaggccaggtgcccttcatccgtgtttctgtggccccttgtgtttattgcagtcacaatactgaatctcgtttcttgtctgtgtcccgtaccatgctggacataaacttcttgagaggaaggactgtcttatttatctttgagttccctgtgtcagactcaatgcctggcacatggttgtttgagaagagttcatggaacgcatttaagaaatacattaggatctatattaagattctaattaagaccgagttgagtgtttatcgagttaaaa

SEQ ID NO: 45118 - DNA, 1186 bp, Homo sapiens
gaagacagagctttggttactactggctggctttccctcctggcagggcattcaagatgttctcctggctgtggtgaaatctaagtgtgcaggttccattgaataggacagtcttggaggtagggacaagggggaggggttccttttgttttctcttgcttatctctgatgcagcaagtcagttgactaggtggaatcaggtctaggttcaaattccagctctttttaatgctaattatgaaactttacacagactgccttttcaacctcagtttccctgaaggtaaaatggggaggactgtgtccaggttgtagggttattatgagcattgaacacagtatcaatgtaaatgtcaggtccatgttaaaaactcagtaattgttaggtttttttcttttttttcaccttctgtatcaaaagactaagaacattactgtatattagaaatgtcagagaaaggtatgtttaaggtaatggagaagaaaattttaatgaccaaggaattaggctgttaacatgcagagtagggcttaacattgtctcattattaaaaaataaaagttgatttaaaacaatattgtgtgtaattgtgaagctggtgtctgttgtgtgatcagtggtaaagcacgtgagttgctaggcacaggtgttgagatttcgtgtttgatcagacttctcttttaagtttaagcctggttgaacacaatctctgtcaggtaccgtgggaaatccttaatgtgaaccatttccatgaaaccctcactactgtccagtggtggcgatgctatttattaaccacatttttcaaatgagagaatgggagtttataggcctaagatcagatgccatcccccagacgcctgccttgatgccagtttcctgttgccacccccaccccctcctgttccagtctaggccaggtgcccttcatccgtgtttctgtggccccttgtgtttattgcagtcacaatactgaatctcgtttcttgtctgtgtcccgtaccatgctggacataaacttcttgagaggaaggactgtcttatttatctttgagttccctgtgtcagactcaatgcctggcacatggttgtttgagaagagttcatggaacgcatttaagaaatacattaggatctatattaagattctaattaagaccgagttgagtgtttatcgagttaaaa

SEQ ID NO: 45119 - DNA, 473 bp, Homo sapiens
cctcctttcactcaaaatgaaaaaactaagtgctgtgatgagaaataggcaatgagatcataacattgaccttatgtcagtttctgtgtcccaactctcaagactttgtgttgtttttctttgttttgtgattactaaagacccactgtgtatccaatactgatcactcagtagaaatacaggtataaaaatgaaagacattgtccttaggaacttagaatataacttggggagaaaggacttacacacattaaggaactataagaaaagaaaaaaaaatgacaacttaatcaaactctgagtagtgtagtgtagtattaacacaatgaaatgtatgaagtgactagccccagattgacagatggcttcctacaggagacgaaatagagtgtggcttgaagttgaagaaggtagaaaggaagttctgattcagcagtttaatatgaaaattacataagtgaaggaccgtgaaa

SEQ ID NO: 45120 - DNA, 136 bp, Homo sapiens
tcgcccttgggctgatctgcactggactatatgaacggtgactgctaacccctggctcctttcccctttcaagatgattgcaggctgattccatggtgtgaaataacccaggagagatagggaggtgtcagcagca

SEQ ID NO: 45121 - DNA, 432 bp, Homo sapiens
acttaatagttaaataactccacgtggctggggggctaccataatatccaccacagtcctggaaacttgccctgccctgatccatctcaagtccctcaggcctgaagttaagctcatcatactgtaactccacagtgcttatgtatttcacctcccgttcctcttcacagaactagtcccacttgcccatccctctctctcctctcttccccaagaaacacatacatactggcatacctgctttgtgctctgctctattacatttgaaagatattgcattttttacaaattgacagtttgtggcaaatctgtgtcaagcaagtctttcagtgccatttttccaacagcatgtgctcacttcaggtctctgtgtcacattttagtaattctcacaatatttcaaactttttcgttattattatatctgttaca

SEQ ID NO: 45122 - DNA, 474 bp, Homo sapiens
gctcgacgggagaactgctcaactctaccatatttttatttcacaaaaatacaaatatggccgtgctattgcataacctactggacaaaggcatcttgccatggcattggacttggtagcccgaggctgctttcaggaatgtaaggcagaaaataaaataaaaacaaaaaaagaggctaggcgcggtggctcatgcctgtaatcccagcactttgggaggccggggcgggcagatcatgaggtcaggagatcgagaccatcctggctaacacggtgaaacttcatctccactaaaaatacaaaaaattagccgggcgtgctggcaggtgcctgtagtcccagctaccagttactcagaaggctgaggcaggacaatggcgtgaacctgggaggcggagtttgcagcgagccacgattgcgccactgcactccagcctgggtgacagagcgagactccgtctcaaaaaaaaaaaa

SEQ ID NO: 45123 - DNA, 253 bp, Homo sapiens
gaataaatttaaagatatattaagtaaaaatagctaaggtaaaagaaagaccatgtgtatgatatacttccatttgtgagaagggaaaaaagagagctacatatgtatgcatgttgtatgtacatacacaatatttggatgtgtacgtaagaaatggtgaacagtcgtttcccctggagaggagaccacaaaatcagaaataagagagatgctcttttcattttatacccaacttactctagatgaatatttt

SEQ ID NO: 45124 - DNA, 407 bp, Homo sapiens
ccttaataaacacacattgtggcacactgggcaacactattagattcctaactaacttttttcacatgtccatttctaatataaaccaaatatgtagaaccatatgcttaaataccactcctgacttaaattgtggacagcatatggtttgtgttacttttccagcctcaaggacaattgtgcattcaccttcccttatccttttccactttcaatcgtaacatgaacaataataaggtggtcagtaggagataggggttttatttagaatgatcaaattctaactgatcaaattttaactgatcaaatcagttaaagataactgatccatgaagttctggaaatcacattaaataagtaatatttgaaggagctatcttcagcctgggataaaaatacaaaaagca

SEQ ID NO: 45125 - DNA, 387 bp, Homo sapiens
tgcccgaaagtggatcttggccttccaaagtgctgggattacaggcgtgagtcactgctcccggcccatctttcccactcttgctgataccatgttagtttaggcagattgggagctttgtagaaatgcagaatctcagtcttacttcagacttactgtatcagaatctgtattacaacaagatctttaggtgattaatgtgcccattcattaaatatagcctgtctattttattgcattaatcccactgttgaaattatttgcttacaacactcttatataccaaagtgacctgaaggacggatgctgtgtcttgtttatctgcatatttctagcgcagtgcctggtacagaataagtatctaatcactgttgattgaaattattc

SEQ ID NO: 45126 - DNA, 1075 bp, Homo sapiens
agcggggctggccccacagcggcagtgtccctcccctccccccactcctctcagtgggggcccctccagtccctgagaattggtactacgaaaaggtgaactcctgggcagaatcttgcctagagcttgcggagtccagccaggcccctgctgaagggccccagaccaccggccacttctcccccgtccatctgaccagctgggcccctgcgcccacctggcctccacgttccctctcctctcacccacacccctggccatggctaactactacgaagtgctgggcgtgcaggccagcgcttccccggaggacatcaagaaagcctaccgcaagctggcccttcgttggcaccccgacaagaaccctgacaataaggaggaggcggagaagaagttcaagctggtgtctgaggcctatgaggttctgtctgactccaagaaacgctccctgtatgaccgtgctggctgtgacagctggcgggctggtggcggggccagcacgccctaccacagccccttcgacaccggctacaccttccgtaaccctgaggacatcttccgggagtttttcggtggcctggaccctttctcctttgagttctgggacagcccattcaatagtgaccgtggtggccggggccatggcctgaggggggccttctcggcaggctttggagaatttccggccttcatggaggccttctcatccttcaacatgctgggctgcagcgggggcagccacaccaccttctcatccacctccttcgggggctccagttctggcagctcggggttcaagtcggtgatgtcgtccaccgagatgatcaatggccacaaggtcaccaccaagcgcatcgtggagaacgggcaggagcgcgtggaggtggaggaagacgggcagctcaagtcggtgactgtgaacggcaaggagcagctcaaatggatggacagcaagtaggcgctggccacccggccctgccttcccaccaccaccaccgtgcatggggcagcaaacacgtggggccgcagacatagcctgatggttaataaatgtgccaagtgagttcatggcata

SEQ ID NO: 45127 - DNA, 298 bp, Homo sapiens
gctaccctttactggagcacaaaataaatggtgttttgggtgaatatatagttttgagactgaatcttagtttttattacttgtggtaagaattgagcaaaattaaatttttataactattggatatattaatatggtaaattggaattttagattacaggaaaaaattgagaaacagattatgtgaaagcattatgttgaagaattatgtgtgtttattctgttatctaataagtattgtgcttaagaaaaaatgtaatatttaaaggatgtagagtttttgtttcataagatgagc

SEQ ID NO: 45128 - DNA, 385 bp, Homo sapiens
aaataaaaattttatttgtacaatggttaagaaattgtaagtaatttttccctaaaacatccaaacttttcttaacattatattgttcttataagtgaaaaaataataataaagatattacttaaacatcactactttaaaacattaaaaattaaaatactatcatttcgaaggaaaaaattaccaattatacacatttttgaaagaacattcactcaaaatcagaagcaacaaaataggaaaaaaaataaatttttcaatcttgaaatctggagattaacacatcaggatatttttaaagatttatttcacttcatttattatcagtaaatctgcctaatgcagctcaacaggaagccttagttgcaaaacaagtactcttaga

SEQ ID NO: 45129 - DNA, 362 bp, Homo sapiens
atcacaccgcccttggttcttatccaacatccagacctatactggggcttctcagaatgggattcccatgaatttgggatgccctgagaggtagcgttagtagtgaaaaaggggaccctgcaaggtggaggcctcaaagccagttatttctgctgccgccctacccaaggagagtgtagatggaagtaaatatctaaatgccctcattagggtggggctgttccaacacaggaattacgacacacggccagactcagaggctgccctctgttctgtggcaaaagggtcccaaagtacagcccactgcttagcctgactgcccttcctaagtacttcttaaagactgcgtgtcccaaccgggc

SEQ ID NO: 45130 - DNA, 313 bp, Homo sapiens
gcaaccttaggaaatattttatcagtatttaaattattttctccttttggcattagtaatacctctacccctgatttccattcatctgctctttaactcattgttttttatagttgcttgtaaacatagattgacttttgggaccgctgtcatagatggggtattatcttttaactgtgtaataataattaccttgaatataatctgagcgcttattctgtgtttgaatttcttttctaacatcctgacaggtgtttaatagtattcatcttataagttggctagagttgtcataaatattgtttgttgtaga

SEQ ID NO: 45131 - DNA, 398 bp, Homo sapiens
gtgagtctcttatagatttgttttgagttagggcgtataaagatgattcattctaatgatagaactaactgttcagtgagccagaattcaagctccgtagtgccataaaatgatgcctgtttcaaggtttaaatttaactgctgtaaaagtattaagagtgtatgtgctacatacaaaaaaatgtgagaatgtttcaagcatttactaagtgtctaccatgtgttgagtacgttatgcacattaagtcacttagtgttctaattaaccctgtgataaatatgcaagtgttttttacacacgtatgatgtgttctacagcattatttatatcagtgacagattttaacaccaggaaaataaattgtaataaaccccttctctagaaattaagagtgtca

SEQ ID NO: 45132 - DNA, 411 bp, Homo sapiens
gcaagaaccttaaaatagtacaattctattttcccctcctgacctttgtactattttgccttacattttacttctatatattttataaaccacatagtacagtggtccccaacctttttggcatcaaggaccagttttgtggaaggcagtttttccacagaccattgtggggtggacggttttgagatgaaactgttccatctcagatcgtcaagcattagattctcataaggagtgcacaacctggatcccttgcatgtgcagttcacaataccatttgtgctcctatgagaatctgatgcctgctgctcctgatctgacaggaggcagagttcaggcagtaatgctcgattgcccaccactcacctccagtactgatctgcagcctgggtgttgggggacccctgccat

SEQ ID NO: 45133 - DNA, 756 bp, Homo sapiens
cttctccatcccccaccccagctgttcctccaaacctctcctctgtagggattctggagcgctctatcagagcccccagggacctcaccccatctggatgcctgccatccctccacctgcacccttgccgttcagcactctccttctccctgagcagtgcctgtacttggcatagagaggttgctctggctgaggaatcacacagagctctgtgaatttcagctctgccccatgtgggctttgtgagccagcaagtctgtagaacgaaggtggttagagtggcctcacaggtgattgtaaagatggatgctatgcaaagccccttcctttcccctcatcgctctgtgcctcttctcatgcaattcattccgcctggactcttactctcctccaatttctgacacagttctacccatcctttcagggccaccaccccgcaaaggtgctccttcctccacacagatgtcccacatctcgagctccacactgtgcacggcagcctgaacccctcctggtcatccctcctggtcaccctattgaactcttttcagatgtccccgctcttttcctagaacccctggcatgccttctttggctcctcctggtcgtctgcctccactctgtgctctgattgccttctgaccattcttttgggtaggactagggtctgccccatgtgtctatccttgtcgcacctgactccttcaacagagggggctgtcagcgtcaactacaggtgctttcacaagaagttgg

SEQ ID NO: 45134 - DNA, 606 bp, Homo sapiens
aattagtaccagagtaaaacaatcaatgatttgtgtttgggaatatttctagttggcattaacgttgttaggagatagcttagctcttcactgggggcccactgaattatcggaaccctggaacacaaatgtgtcaaaagggtgtaatcaaaattatgtcagggaatgttaagtttctagtctttggtcactgaggcctatcagtaggtttgggtgttttgttttgtttttcccacaaagaggctttgagtaagaattgtgtctggtagacaaacacaggtacacacacaggtgtgtactcacacagcaagagcagtagagatcatctcccacaacacaagagctcatgaagaaagggaattgagcttcaatgtaagcattagtttagcatttttggagcctgaatgtgttgactttacaaattaagaagtccctgaacaaaaacgtcaaaaacaaatcccaagttgcagtctgcccaggtaattcatgtctatcaagtgtctacaataccaatttctacatctttgggagtattttataggtttgtttgaagagcaaggtcaataactctttccccaagaaataaatgaaatcataaaaaaaaaa

SEQ ID NO: 45135 - DNA, 412 bp, Homo sapiens
agcagaaccctctgtgtgtgagtgtggacactttcctggggaatgatttatggtgtctcatgtgagacagaagcacatctacattctagaagacgcatggcctcggtggcaggatgcacaaagtgtgtgcatgaggagaatattagaagcacagaaattgattaggaggatgtggtcaaaaagagggacggaggaacaaacctaagagaaggagatgcaagtgcagtggagggagaaggggcggggccaagaacacaggtgaacacaaacaccacggatgcaaagaaaacttcccctcacccctctcaaaggaaagaccagttctgatgaatttggaagcagcaggacaagaaggccaggacagaatttcctgaagacctctacatttcttacacaaaacaagggcacccac

SEQ ID NO: 45136 - DNA, 397 bp, Homo sapiens
cctctctcaatctcttttgtttttcaccccaaattcagttttccaataggtgtcatttattctgatgctctgacatcttctgaaagattctcatgcccaagctatacagaccttgcatgcttttaaaacacaatggcaacaggctcctgctggagtcccccagcgccgaatttccagcagaacctttggaatcctcgcagccgccttgtctgccctgggctgtgccgccccagctctgatcagctcaggacacttgcaggctccgtggtactgtacattaactctgcagcagcctggctcagctgcagagactgctgcctgacaggggatgtgctggcgtcaagggggccctctaggtgggttcccagacattgcagagccgcgcactccttgctaa

SEQ ID NO: 45137 - DNA, 791 bp, Homo sapiens
tggagggtagtacagaactcaggaaagtttagattttctcattatctcattaagattgaaattctacactcttctcctgtgaatattttcctattacttattctacatttttatgtgatgggattggaatataaaccaatagctgccatcaatagctatgacatggtatctttttttatagttgcttttatttatgcatattgtgttgctcggttagttgagaacccactttgtatcccaccttcctgagtaaaaaaaatgatttcacatggttgggagtaagaaccttctttttcctccttcatgctttcatgtggtgtgacatccactagttcaagagtttaaaactcttagtcgcagggaggtggtgtggctggggaggtgagtgaaccgagtgtgtatgtgtctgccctgttcctatagagagttcgtgctgtcgggtttggctgccagctatgtggcacgtgctactctgaaggcctgcttcagtcgggagaggagagtgatggtcagagcttcctatgattaaatggctaagagtcataacaaggttcagtattaggatgcgtattgtcatgtgcataagccacatcttccattatagtcttcactgattttctgaaaattgatattttgctctgcatttactggatttctctatatttacttttcaattgattacaaactcatgtgagggaaaagggatgttataatgacttattaaaacatagaaggggagaatgggataagcttaatgagacatataatgggataagcttaagattctccaa

SEQ ID NO: 45138 - DNA, 350 bp, Homo sapiens
tgcgagttgttgagattttcctggttctttgtatgacaagtaattttgaatgatatcctagatattttcatcattactttattgactctgggtcctgtttataacctatattgagcattaattttttttttcaattttagcagccatttgatacagttaggttcattttccagcttctgcgtgactcccttcctaatcttctggctgggggcttaggtctgcctattctgctcttctccagggccaagtgtggggaggataaagagaaaaaagtaacagaaatttcagaccctctcactctagactacagttcatctggtcataaacaaggatttccatcagagttttgg

SEQ ID NO: 45139 - DNA, 622 bp, Homo sapiens
agtgtctttgcgagagggcaatgttttatctgactcgaacattttcagagtccaggagcagccgagctcagaggcacagaggagaggaggcagttggaggaagtgggctgtgttgggtttgatgtcgtgagtcctcaagccagggatttctggatttctgctttagatcgtgggtggccatgtggcttcctgattctaggttctgtggcttggcttcctccaccccatatcctccataacctcagggtgctgctgtagtccttcttcctcagggtgaatcttttgtccgttcctggcctcttgggtgggggtgggtggtgtcagatgatcaccagaggactctagattcttcacctgccatttgtctatctctgtcaacctcaggaatcatggcgtttctgcattatggtcttcagcaagacttgtcttatacaacttagcttaggagacatatggatgaagcgaggcctgtcccttaagcttgaggctgttggctcatgctttggcgtcagggcaaacccttggtgctcacaagcagagctttctcctgtcaagaagtggaggtgagactcacctttgcctctatggggttgggtcacacttctcaatatgggtctggtgg

SEQ ID NO: 45140 - DNA, 417 bp, Homo sapiens
ttaaatatgagaggatgtaagatccttaagcatgtacaaattttcgtggcatctatcacagtcctgaatcctgaaagactattttctgttgagttagatctttccttataaatgctttctgggatggcccatgcatctctgacagttctcatgctgagtcataccttgttctgttaaatttatccattattggacaaagactggaagaatggatatgacattgggaagtgtgcaagacttccacagatcacttgtagagagggatgatttcattgtaatcctacctcactggacacctcaaacctgccagtctcatctgtaaagtgagcatttttatcccctttccttggctctcttggctccatctacaggcaacactcaggtggacttctttactgaagagaagagcgtaatatt

SEQ ID NO: 45141 - DNA, 673 bp, Homo sapiens
aagaagtggattctagaaatggaggtcattaaatgctcaatacttgcgaattgtaatgttgatctgcatttttctgtttagctttatttgtgaaatataatatgtagttcttaaagaaaaattccataagccttttttttctttcgtatgggcttaaaaatattttagaaacttgttaaaaactagttatagaaatattcattatcctactaaaagtggcaggaggaatatagttgtgatttaagatatagaaattgttttgtactaatgtgtttattgtcagcaattacattgttaaaatgtaacaagtaaattttgccaagagtacaacatgtatccatttgtaagtaagcacacagggaaaacaatattttaaatgttctacccattgaattatttttctagtaaacaacttgacataaaatagactgaaacatccatttattttaacaactatgttaaattacagattaatggtccaaaataaaatttgaactgatttaatacataattcagttttgggggaaaatagatctttctccaactgagaatagactatatatttttcttttgtgaataacttattttacccttaataagtttaggacttgcctgaaccacagccagccttaagaatcctttgttcagaaatgttcagcgttatattgactaa

SEQ ID NO: 45142 - DNA, 589 bp, Homo sapiens
cagggcccttcaaactgggaaacacacacttctgggagaatttaaagatttgccaaggggttctgaggcacagatagtgatgacgatgataataataatactacagagttgtgtgcatggcttagtacagttgctaagttaactgaattaacacgtgcaaggggcttagcactgggattggctcatggtcaggttccctaactcttggctgcgactctttcaacctgtgagtcctgggggattgaggatggcgatcagggaagccttcaactggcagagaggaccttgggagaactggcaaggggtgctgagccaagggagaggtgaacagcatgagaagaaggtaggaggtaggtgaggccattctgtatttggggacagtgaggtcaccttcccactcgtgtgtgtgggcggccgatgattgatttctgtcatacctgttaccatttggtgcagtatcgatgtatcgttggtgtctgtcattaactctgaagtaacttttacttgatcagtactgaatttcattcctaggcttctcagtcttcatagttgactgctcctgtagttttgccatttattactgcttaaa

SEQ ID NO: 45143 - DNA, 282 bp, Homo sapiens
tggatatttataacatattttatatcacaaactcttaacagtaatcactttttttgtgtaataaatacccaagtatttgaataattttaaattctgtgaaggaaaactaaaattggataatatttattttgcccttttaataaaaattgtggtatttttattactcaaacattagaatttattccagctaattttagtctttgctttctagaattagtaaatattctttttcccttcttgatagttcctttatacctcacataacctttcacttaatggccg

SEQ ID NO: 45144 - DNA, 314 bp, Homo sapiens
tagtattaattaattgctataaagaaacggctgaaacaggtagtttatttatttttaaatatttatttatttatttttgagacagagtttcactcctgtcgcccaggctggagtgtagcggcatgatcttggttcactgcagcctctgcctcccaggctcaaccaattctcctgcttcagtctcccgtgtagctgggattacaggcaggcacccccacgcccacctaattttgtaattttagtacagacggggtttcaccatgttgcccaggctggtctcgaactcctgacctcaggtgatccacccacctcgg

SEQ ID NO: 45145 - DNA, 284 bp, Homo sapiens
ctcattacaatggacaataggtaccacttctacctacaagaattataaacataggccaggcatggtggctcacgcctgtaatcctaacactttgggagacagaggcaggaggatcacttgagctcacaagtttgacaccagcctggtgagggagactgagaagtcggcactatgaggaaatgaagccatgtaccctgaaaagtgtaaatttggaagaaagctggatgaccatcttgaaatgcttgaaaggatattgtacaggtagtactaaattatgacccctt

SEQ ID NO: 45146 - DNA, 683 bp, Homo sapiens
tatgattgcttgagtacagttccttggaaaggacacaaggggtttcataaagcggtactaaaaatctgcttttctccctagcatttaccaacaaccttgcgatccgatggcttgaaataatggtcagagtgcatgttacccaacttctcctggctgctcctactctgtcacactgcacacagatcatgcccgccaccaccctacactccccgacctcacccaccagtcagacagtttaagtcctgctgacgcaccaggcgtgtgttggctcgtggttgtacttttcatgagtagcagggaagatacactccaggaaggcgggatacaaattattgaactgtgtgacttaaaagctccagtgagtttcgtcggaagtataggagtttgaaagtgctccccagtcaaacccagaactacatagggtcagccgtggttgagctaatttctgcttacacatgtgtggagggtgtcattttctgactacgcctaggcctgagtggacagccgattaaaagatgtaaattcgtggattgtatcaaggagagcgggttccatctttgtggtcaggagggggcccactcttttgttccgcaaagggtttatctggatgttccttgctggaagttgcttttccagtttggatcaaaccacttaagtggagctccagcctcagtccttgcaat

SEQ ID NO: 45147 - DNA, 443 bp, Homo sapiens
gcaggaatatggcatgttgaaagcatatgtcctaccccaaattattattttttatcttaactagagaaaaggagagttgggatgacatagatgattatttagcaaatcttcacttccttctctctgccactgttgacatgtatttctccacctcattgatgttgggcttggtcacgtgattttcttggagcaatggaacatggatagaaatgacagtgcaattctgaacgtaggccttaagaaccctctcacgtttctgcttctctttattgtgcttttgccactgtcttgaaaacaacgtgcctccccggtagctcactgatcccagaataagaggtatgtggatcagagtcaccctagctgacccacagacctgcaacatgaagcagaacaaccctagctgatctgtaggctcacaagaatgaagttaaatggttattgtt

SEQ ID NO: 45148 - DNA, 460 bp, Homo sapiens
tgcctgataccggcccttcccaactccagccttctctccttcctgaacccagcttccatcagaaaggcctcaactggttgttcctggccttcagatttcccatctttccatttcctttctttttttttctttttgtacatacagtgtactaaaaatttaaaacagagtttgacccaacatttaaatattggatgctcacatagaatccttcttttgaaaaatcagatcttggccaggcacaggggctcaagcctgtaatcccagcactctggaaggctgaggcaggtggatcgcttgaacccaggagttcaagaccagcctggccaacatggtgaaaccatctccctacaaaaaataaaaaagttagccaggtatggtggtttgtacctgtagtcccagctactggggaggttggggcgggaggatcccttgaacctgggaggtcgaggctgcagtgagc

SEQ ID NO: 45149 - DNA, 483 bp, Homo sapiens
tgtccagggcggcctgctaggctctggtagagccagggctggaatttccctggccccagatcccagagtctagaggttgcagcggggttcaagcctggttacccagtccctctggggtagggctggttctgtaggaccagatggggcgacagacaggcccagctgctgggaactccaggaccaatcaccagtgcccacagagcctcgccaaggcaagccctgctgggctggcacagcctctgaggccaagcctgctcccccagtgcagtgggggttgggggatgggatctggccccggcggagcgggagggactgggtggcggatttgtgtttccacttgatttcctcagttgttttccaagagcggtggcaggatcctgaggggaggggtggatgtggggaagccaccggaaggcgccacggccccgctgcctgccccccatgtgactccactgactgacgacagtgcccgtggaagggcct

SEQ ID NO: 45150 - DNA, 370 bp, Homo sapiens
ctgcaggttagatggaagctgggagttgtctagggttgtggcagttgagaggggtaagccaggcctggctgttgtgttttctgcttcaacaaatgccccctccccttcagggagtagcctattcttacccctatccccccaaatctagagtgatggcccttgctgcctcctgaataaaaggcccgtgttggtcattgggcaattcagtgtctaaagaaacaggacagtaggaatagtggtgcctcctgtgctggagtctttgtcctttattgggctaccatggggtggcccaggctttggggctacaaaagcctgggctgcatctctttctagctccatgatcctaggcaaggcacttagcctctctgag

SEQ ID NO: 45151 - DNA, 422 bp, Homo sapiens
ttgaatatctgtctccatttgtagatacgaaactcctcagggcaggggccaggtctgtcttcactgggtatacccagtgactagaagagtacctggcctatggtaggtgcccagtaaacatttcttgatttactgagcctttcaattcccaacactccacaactccacacccctgcacgccttcctctatctggtcagtgctcagtgcttcgttcttttttttttttcttctaatacagagttttgctcttgttgcccaggctggagtgcaatggcacaatctcagctcactgcaacctctgcctcccgggttccagcaattctcctgcctcagcctccggagtagctgggattacaggcggtgccaccacgcccggctaatttttgtatttttagtagagacagggtttcaccatgttggc

SEQ ID NO: 45152 - DNA, 273 bp, Homo sapiens
aagaaagaaaaaaacacagaagatcccacaggagaagatgcacatgactcccttctttgtagcattttctagttcccccgcaccgtcagtggtattatctccctcgtgcagccctggcatatctgccccacatctgagaggcatgcgcaggcccagagaggttaagggccatggccaaggtcacacagcgtgtaagaggcacagcaggaacaagaagtcgtttcttgcaactataactccagtgatgacttgcatacaaggcgtgggctcaga

SEQ ID NO: 45153 - DNA, 357 bp, Homo sapiens
ccagccccagcctccaccccagcagcagcatcagccccctccacggcccgtgcacttgcagcccatgcagttttccacccacatccaacagcccccgccaccccagggccagcagcccccccatccgcccccaggccagcagccacccccgccgcagcctgccaagcctcagcaagtcatccagcaccaccattcaccccggcaccacaagtcggacccctactcaaccggtcacctccgcgaagccccctccccgcttatgatacattccccccagatgtcacagttccagagcctgacccaccagtctccaccccagcaaaacgtccagcctaagaaacaggtaactggcagggc

SEQ ID NO: 45154 - DNA, 6412 bp, Homo sapiens
  misc_feature (3648)..(3648): n is a, c, g, or t
  misc_feature (3925)..(3925): n is a, c, g, or t
  misc_feature (3942)..(3943): n is a, c, g, or t
  misc_feature (3947)..(3947): n is a, c, g, or t
  misc_feature (3949)..(3949): n is a, c, g, or t
  misc_feature (3959)..(3959): n is a, c, g, or t
  misc_feature (3980)..(3980): n is a, c, g, or t
  misc_feature (4010)..(4011): n is a, c, g, or t
  misc_feature (4017)..(4018): n is a, c, g, or t
  misc_feature (4033)..(4033): n is a, c, g, or t
  misc_feature (4038)..(4038): n is a, c, g, or t
  misc_feature (4046)..(4046): n is a, c, g, or t
  misc_feature (4048)..(4048): n is a, c, g, or t
  misc_feature (4056)..(4056): n is a, c, g, or t
  misc_feature (4060)..(4060): n is a, c, g, or t
  misc_feature (4065)..(4065): n is a, c, g, or t
  misc_feature (4089)..(4089): n is a, c, g, or t
  misc_feature (4108)..(4108): n is a, c, g, or t
  misc_feature (5457)..(5457): n is a, c, g, or t
ggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcgtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcagaagtgaaagcaaggcaagatgtgaaaccagacatccgacagcctccattcacagactacaggcagcccccgctggattacaggcaacccccaggaggggactaccagcagcccccacccttggactacaggcagcctcccctgctggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacggnaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggccngggggctgcgccggcgnntgcngncccgggcagncggcggcagcggcgcgctggnggccgagggcagggcgggtgcgcgcgcggnnccccgnncggtgcccgcgaccnccggngggcgccncngcgcgcanggcngccgncgcgccggggccctggaaggtgcngggttctgacaagctgccnagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattanttagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaactaaaaaaaa

SEQ ID NO: 45155 - DNA, 534 bp, Homo sapiens
caggcaagaagcgggtctttcagggaaagagctgttatcaattttgtttaagtcaaaccatgaactgaattccttctcaaagttagcttggcctatgcccaggaatgaacaaggacgacttaaagattagaagcaagatggagtcggttaggtctgatttcttccactgtcatagtttcctcggttacaatttggcaaaggcagtttcaccctcccctgggtagcagtagagggaggagaagtagatgaacgcaacttctgaagctcctccagctctaaggttctatgatcctatacaacaggtgacagtcatagcccatatttgtcttccaactggccaccttttcagattctcaggcttccttggttgtttttccttttctaccacagtcttccagagctcattcagcagcctgcaagcagtagaacagaagagaggataggaaaatttgtgcatttttcatgttgaagtgatttggcccaaaatgttgggtatggaaacacgaaaataaaggagcactaagagaaagtaaa

SEQ ID NO: 45156 - DNA, 377 bp, Homo sapiens
cactaatttcacttgctgcatgcttgatagggttagctttacttaaagtctttattcttactgcctagataatttttattcaactgctctaaacatactaagcaatcttgattctaacagtaataatatatctttgttactggttctgttaattctaatgattggtcctaggctgttcctccccttcctttaggaatggtaccttccagtctctccatgtgcatgaaaagtgacaagcatgggtccccatatttctacttattgggccaccctaaagacacggtttttaactgatgtataatgctttctctttcatagtagcttgtctaattatttctagagttctggaatatatgtatagctcagaccttataagt

SEQ ID NO: 45157 - DNA, 312 bp, Homo sapiens
agcaggacgactagtaggaggatcccccgctcgcgaaactaaaagtgttttaccggatcctagcagtgaatggccagtctatcatcaacatgcctcacgctgacatcgtgaagctcatcaaggatgcaggtcttagtgtcacccttcgcatcattcctcaggagggtgagtgcctgaggcagccttgcagagaggcggccaacacatggacacactcaccgggtgttctcagcctgcccgccagggtcgcggagtgcacctgcctgccgtcactgtggtgtcagagtgtcagaggttgattattatttccac

SEQ ID NO: 45158 - DNA, 6827 bp, Homo sapiens
  misc_feature (4125)..(4125): n is a, c, g, or t
  misc_feature (4402)..(4402): n is a, c, g, or t
  misc_feature (4419)..(4420): n is a, c, g, or t
  misc_feature (4424)..(4424): n is a, c, g, or t
  misc_feature (4426)..(4426): n is a, c, g, or t
  misc_feature (4436)..(4436): n is a, c, g, or t
  misc_feature (4457)..(4457): n is a, c, g, or t
  misc_feature (4487)..(4488): n is a, c, g, or t
  misc_feature (4494)..(4495): n is a, c, g, or t
  misc_feature (4510)..(4510): n is a, c, g, or t
  misc_feature (4515)..(4515): n is a, c, g, or t
  misc_feature (4523)..(4523): n is a, c, g, or t
  misc_feature (4525)..(4525): n is a, c, g, or t
  misc_feature (4533)..(4533): n is a, c, g, or t
  misc_feature (4537)..(4537): n is a, c, g, or t
  misc_feature (4542)..(4542): n is a, c, g, or t
  misc_feature (4566)..(4566): n is a, c, g, or t
  misc_feature (4585)..(4585): n is a, c, g, or t
  misc_feature (5872)..(5872): n is a, c, g, or t
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcagaagtgaaagcaaggcaagatgtgaaaccagacatccgacagcctccattcacagactacaggcagcccccgctggattacaggcaacccccaggaggggactaccagcagcccccacccttggactacaggcagcctcccctgctggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacggnaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggccngggggctgcgccggcgnntgcngncccgggcagncggcggcagcggcgcgctggnggccgagggcagggcgggtgcgcgcgcggnnccccgnncggtgcccgcgaccnccggngggcgccncngcgcgcanggcngccgncgcgccggggccctggaaggtgcngggttctgacaagctgccnagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattanttagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaactaaaaaaaa

SEQ ID NO: 45159 - DNA, 5157 bp, Homo sapiens
  misc_feature (4125)..(4125): n is a, c, g, or t
  misc_feature (4402)..(4402): n is a, c, g, or t
  misc_feature (4419)..(4420): n is a, c, g, or t
  misc_feature (4424)..(4424): n is a, c, g, or t
  misc_feature (4426)..(4426): n is a, c, g, or t
  misc_feature (4436)..(4436): n is a, c, g, or t
  misc_feature (4457)..(4457): n is a, c, g, or t
  misc_feature (4487)..(4488): n is a, c, g, or t
  misc_feature (4494)..(4495): n is a, c, g, or t
  misc_feature (4510)..(4510): n is a, c, g, or t
  misc_feature (4515)..(4515): n is a, c, g, or t
  misc_feature (4523)..(4523): n is a, c, g, or t
  misc_feature (4525)..(4525): n is a, c, g, or t
  misc_feature (4533)..(4533): n is a, c, g, or t
  misc_feature (4537)..(4537): n is a, c, g, or t
  misc_feature (4542)..(4542): n is a, c, g, or t
  misc_feature (4566)..(4566): n is a, c, g, or t
  misc_feature (4585)..(4585): n is a, c, g, or t
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcagaagtgaaagcaaggcaagatgtgaaaccagacatccgacagcctccattcacagactacaggcagcccccgctggattacaggcaacccccaggaggggactaccagcagcccccacccttggactacaggcagcctcccctgctggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacggnaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggccngggggctgcgccggcgnntgcngncccgggcagncggcggcagcggcgcgctggnggccgagggcagggcgggtgcgcgcgcggnnccccgnncggtgcccgcgaccnccggngggcgccncngcgcgcanggcngccgncgcgccggggccctggaaggtgcngggttctgacaagctgccnagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacatt

SEQ ID NO: 45160 - DNA, 6545 bp, Homo sapiens
  misc_feature (3781)..(3781): n is a, c, g, or t
  misc_feature (4058)..(4058): n is a, c, g, or t
  misc_feature (4075)..(4076): n is a, c, g, or t
  misc_feature (4080)..(4080): n is a, c, g, or t
  misc_feature (4082)..(4082): n is a, c, g, or t
  misc_feature (4092)..(4092): n is a, c, g, or t
  misc_feature (4113)..(4113): n is a, c, g, or t
  misc_feature (4143)..(4144): n is a, c, g, or t
  misc_feature (4150)..(4151): n is a, c, g, or t
  misc_feature (4166)..(4166): n is a, c, g, or t
  misc_feature (4171)..(4171): n is a, c, g, or t
  misc_feature (4179)..(4179): n is a, c, g, or t
  misc_feature (4181)..(4181): n is a, c, g, or t
  misc_feature (4189)..(4189): n is a, c, g, or t
  misc_feature (4193)..(4193): n is a, c, g, or t
  misc_feature (4198)..(4198): n is a, c, g, or t
  misc_feature (4222)..(4222): n is a, c, g, or t
  misc_feature (4241)..(4241): n is a, c, g, or t
  misc_feature (5590)..(5590): n is a, c, g, or t
ggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcagaagtgaaagcaaggcaagatgtgaaaccagacatccgacagcctccattcacagactacaggcagcccccgctggattacaggcaacccccaggaggggactaccagcagcccccacccttggactacaggcagcctcccctgctggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatggaatggtaccttccagtctctccatgtgcatgaaaagtgacaagcatgggtccccatatttctacttattgggccaccctaaagacacggtacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacggnaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggccngggggctgcgccggcgnntgcngncccgggcagncggcggcagcggcgcgctggnggccgagggcagggcgggtgcgcgcgcggnnccccgnncggtgcccgcgaccnccggngggcgccncngcgcgcanggcngccgncgcgccggggccctggaaggtgcngggttctgacaagctgccnagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattanttagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaactaaaaaaaa

SEQ ID NO: 45161 - DNA, 6889 bp, Homo sapiens
  misc_feature (4125)..(4125): n is a, c, g, or t
  misc_feature (4402)..(4402): n is a, c, g, or t
  misc_feature (4419)..(4420): n is a, c, g, or t
  misc_feature (4424)..(4424): n is a, c, g, or t
  misc_feature (4426)..(4426): n is a, c, g, or t
  misc_feature (4436)..(4436): n is a, c, g, or t
  misc_feature (4457)..(4457): n is a, c, g, or t
  misc_feature (4487)..(4488): n is a, c, g, or t
  misc_feature (4494)..(4495): n is a, c, g, or t
  misc_feature (4510)..(4510): n is a, c, g, or t
  misc_feature (4515)..(4515): n is a, c, g, or t
  misc_feature (4523)..(4523): n is a, c, g, or t
  misc_feature (4525)..(4525): n is a, c, g, or t
  misc_feature (4533)..(4533): n is a, c, g, or t
  misc_feature (4537)..(4537): n is a, c, g, or t
  misc_feature (4542)..(4542): n is a, c, g, or t
  misc_feature (4566)..(4566): n is a, c, g, or t
  misc_feature (4585)..(4585): n is a, c, g, or t
  misc_feature (5934)..(5934): n is a, c, g, or t
agccttgagtgtcattcaagggacagcacaacctcatccaagctctcctacctctgcccagccgtccctctcatcctccccattcctcgtccacactccatccaaagaagagggaaagcaccgaatagaggggggcgaaggcaaagtctgctgttcttccccctgggcccccttgctcctccatcctcattctctcaccaccagcccccctaaccccaaggagcccaggaactgaggcgactcgccccactgccatgtccaaaagcttgaaaaagaaaagccactggactagcaaagtccatgagagtgtcattggcaggaacccggagggccagctgggctttgaactgaaggggggcgccgagaatggacagttcccctacctgggggaggtgaagcccggcaaggtggcctatgagagcggcagcaaattggtgtcggaggagctgctgctggaggtgaacgagacccccgtggcggggctcaccatcagggacgtgctggccgtgatcaaacactgcaaggaccccctccggctcaagtgtgtcaagcaaggaggaattgttgataaagaccttcgtcactacctcaacttacgatttcaaaagggttctgtggaccatgagcttcagcaaatcattcgtgacaacctctacctccgcacggtgccatgcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataactgtgccccataaaatcggacgcatcattgatgggagtcctgcagatcgctgtgcaaaactaaaagtgggagaccggatcctagcagtgaatggccagtctatcatcaacatgcctcacgctgacatcgtgaagctcatcaaggatgcaggtcttagtgtcacccttcgcatcattcctcaggaggagctcaacagccccacctcggcacccagctcagagaagcagagtcccatggcgcagcagagtcccctggcacagcagagtcccctggcccagccaagcccagccacccccaacagccccatcgcccagccagcaccacctcaaccacttcagctgcaaggacacgaaaatagttacaggtcagaagtgaaagcaaggcaagatgtgaaaccagacatccgacagcctccattcacagactacaggcagcccccgctggattacaggcaacccccaggaggggactaccagcagcccccacccttggactacaggcagcctcccctgctggactacaggcagcactcccccgacaccaggcagtaccctctgtcggactacagacaaccccaggattttgattatttcactgtggacatggagaaaggagccaaaggatttggattcagcattcgtggaggaagggaatacaaaatggatttgtatgtgttgagactggcagaagatggaccagcaataaggaatgggaggatgagggtaggagatcaaatcattgaaatcaatggggaaagcacaagggacatgacacatgccagagcaatagaactcatcaaatctggaggaagacgagtgaggctgctgctcaagagaggcacgggacaggtcccagaatatgacgaacccgccccctggagttctcccgctgccgccgccccaggtctgccggaagtaggcgtctccctggacgacggcctcgctccattctctccatcacatccagccccaccctccgacccttcccaccagataagcccaggcccaacttgggatatcaaacggnaacacgacgttaggaaaccaaaggagctttcagcctgcggccagaagaagcagcgcctcggggagcagagggagcgctcggcgagtccgcagagggccgcgcggccgaggctcgaggaggcgcccggcggccaggggcggcccgaggccggcaggcccgcctcggaggccagggcgcccgggctcgcggcggcagacgcggcggacgcggcgcgggcgggcgggaaggaggcgccccgtgcggcggcgggctccgagctctgccggcgcgaaggccngggggctgcgccggcgnntgcngncccgggcagncggcggcagcggcgcgctggnggccgagggcagggcgggtgcgcgcgcggnnccccgnncggtgcccgcgaccnccggngggcgccncngcgcgcanggcngccgncgcgccggggccctggaaggtgcngggttctgacaagctgccnagcgtcctcaaacccggcgcctcggccgccagcagatgagccgcgcggccacggccaacccgcccgccccggcgcaggcagttcttcttaggttccgtctcacggcgttttaatttattttcactgtcacacgcatagatccacgaggcaccaaggcctgggagcatcgacgtgaagtcccacgtgtccggtgtgcttgggcggcatcgcatcaacgcgcagacctaaactgatcctaaagcccccggttcccttgtgggggctttggcagctatggaagaaccaaaataacgtgaagaacatcacagagagacagtgcagtgtagctttagtttaagaaaaaaaaatattcctccccactgcatgaaggacttggatgtcatccaaactttatatcaagaaacaggacaaagttaagagcaatcacaaactggaatatcgccttaaaaatcaaactgcacggagcaagctgaaactgagacaagattatatcttttaattgatctaaagcgttgtaaataaattgttctcgacatatctagacaggggttaaagggtttctttgacacattcggaaccgttcacccatgacatgtttccatggctcacccttggcatccatcctcggtgttagcagcagcgttccctgcctcctgcaggatgacttagaaatctagtgagtttcttggtgtgatgccatttttattgccctttctgtgatcaaatcatatttctgtacattttcagtggtagaaaaaaaaggttttaaaaattgtatcctagggaacagtttgccataagtcagaattttgcagtttagctcatagatcttaattggtttttctctaaaatatgaattttataattgaaggaccacaatttgtttaatcaagataggcaacgctgcagttcctttatgaagaggcttttctgtcgtcccaggctagcagagatggatagcttctttgtcagcaatgtgatttcacttattttattgtcttattttaaaccctgtctccatgacttcatttgcactttgacagagcagaggcagagtatttgtcttatatttctcagattataatattaaaaaattacaatcaatttattttcattaaagaacgtgagtctttttagcattcctttctgcttatccttctttccttaccctttgtccttttgtttccattagttttctttcgtcttgtattccttgccactttattttgttagcaacttctagatgtttatcttcatggatctatgattgacctcctagtaaaattctaagtcttgcctttcttccctgctgttttagcatttctttgtaaaatgttagcttcaattanttagccattggtacttactgtagctacacatattaaaaggcaaagtgtttctgaaggcaatttctttttaatatgcccgaatgaatgaggcttcatcctttccatattcttactctttacaggagttcaaatgcaaataagctccacctccctgcacttgtagtctaaaaagtaaaaggggcgatcaggtccatctcaaaggtcacacgtaatagcctccctgggctgatcattccctctccttgtaattgcagtatcctgagtagcagtttaattttcatcaaacatcggagtagtttagttgtttgacaggaggagaataaggctgaaagcctcaagtgaaggatcttgcagcttgtaaaagcaatttccaaaaatgaaacccattcatcgtaaacaaaagcacaaacacttgtagcagtttataatgcttttggtttaatctcaattagtctttctcccctggactagaaatccagtatagtttgccattaatttattgaatctggttttggacaatgcttctgtagtgtagctgcacgtcctggtactgtatcctctgactttattttccatgtattacaaaaggaaaaaaaaattgagattacactggcataaactctagtttgcacagttcacagctactacttgtgcagtaattgctttatgcggctgtaatccataacctgtgaagacagcacatcatctaaatcccattccaaataatatttgtgtagtgttagctgtgaatttaccctgtacagctgtatctctataaatataattccatgtattaatagtcacagaaagactgtaagtgagcaactatttttatgaaacgtaccactatggataaattaacttttacagaaatcttgtttactgtatgatattctaaaacactgtcaaataaaatatatatccaaaaatcttttctttttccaactaaaaaaaa

SEQ ID NO: 45162 - DNA, 2808 bp, Homo sapiens
ggaaaacaaaagagctcagcggcagttttgtgttgctgtgtctggcttaaagaggaaaattctagacatccatgttgaaaaatcaaagctcagctgagactacttctatcaagaaaattatttttatctgcgaatgggttggatcagtacaggtggtttgagaagacactgactgaggaccatggaaaggtgggagaggacgtgcggcttctctgcttcctttgaacagagctctaggcaccacaaggccacataaggagggtgaggtccctggagtggattatattttcatcactgttgaagattttatggaattggagaaaagtggtgctctcctagaaagtgggacttatgaagacaattactacggtaccccaaagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaagctaaacctccagaagagtgcaaagaaaatgagcttccatatggctgggaaaaaatcgatgatcccatttatggcacttattatgttgaccacataaatagaagaacacagtttgaaaatcctgtcctggaagcaaaaaggaagctacagcaacataacatgccccacacagaacttggaacaaagcccctgcaggccccaggtttccgagaaaaaccactcttcacccgggatgcatcccagttgaagggaacattcctcagcaccaccctaaaaaagagcaacatgggctttggatttaccatcattggtggagacgagcctgatgagtttctgcaggtgaaaagtgtgattccggatgggcctgcagcacaggatggaaaaatggaaacaggtgatgtcattgtctatattaatgaagtttgtgtccttggacacactcatgcagatgttgtcaaacttttccagtctgttcctattggtcagagtgtcaacctggtgttgtgtcgtggctaccctttgccctttgatcctgaagaccctgctaacagcatggtgccaccccttgcaataatggagaggccacctccagtgatggtcaatggaagacacaactatgaaacatatttggagtacatttctcggacctcacagtcagttccagatataacagatcggccgcctcattctctgcactccatgccaactgatggtcagctagacggcacgtatccaccgcccgtccatgatgacaatgtgtctatggcttcatctggggccacccaagctgaacttatgaccttaaccattgtgaaaggtgcccagggcttcggcttcactattgccgacagtcctacaggacagcgggtgaaacaaatacttgacattcagggatgccctggcctgtgtgaaggcgacctcattgttgagatcaaccagcagaatgtacagaacctgagccatacagaagtagtggatatacttaaggactgtcccattggaagtgaaacttctttgattatccatcgaggaggtttcttttctccatggaaaactccaaagcctataatggaccgatgggagaatcaaggcagtcctcaaacgagtttatctgctccggccataccgcagaacctgcccttcccacctgcccttcacaggagctcctttcctgactcaacagaggcctttgacccacggaagcctgatccatatgagctctacgagaaatctagggccatttatgaaagtaggcaacaagtgccacccaggaccagttttcgaatggattcctctggtccagattataaggaattggatgttcatcttcggaggatggagtctggatttggcttcagaatcctcgggggagatgagcctggacagcctattttgattggagctgtcattgccatgggctcagccgacagagatggccgccttcacccaggagatgagcttgtgtatgttgatgggattccagtagccggcaaaacccaccgctatgtcatcgacctcatgcaccacgcagcccgcaatgggcaggtcaacctcactgtgagaagaaaggtgctatgtggaggggagccctgcccagagaacgggagaagtccaggctctgtatccacccaccacagctctccacgcagtgactacgcaacctacaccaacagcaaccacgctgcccccagtagcaatgcctctccccctgaaggcttcgcctcccacagcctgcagaccagtgatgtggtcattcaccgcaaagagaatgagggcttcggctttgtcatcatcagctccctgaacaggcctgagtctggatccactataatcttccagagctcattcagcagcctgcaagcagtagaacagaagagaggataggaaaatttgtgcatttttcatgttgaagtgatttggcccaaaatgttgggtatggaaacacgaaaataaaggagcactaagagaaagtaaa

SEQ ID NO: 45163 - DNA, 395 bp, Homo sapiens
cccacgcgtccgcggacgcgtgggtcacccacgcgtcggtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggaaaaaaaacctgtg

SEQ ID NO: 45164 - DNA, 1107 bp, Homo sapiens
  misc_feature (57)..(57): n is a, c, g, or t
gctgagctccggggaagatggacgaggcgcggcggtggtatgaagaggccttagcantcagccccacccacgtgaagagcatgcagcgactggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatgaatctgccgcactgaggccagggacgagtgttcagtgggccacagtgaaccaaccaaaccaaccccgaatcatcgctctcgccatgtgcgtttctcttgttttttttgccagcccaatggtagtttctgaacctattgacattgttcaaaatggatcatgtgccatattttgttagttgacatctgagttttcagtaaaatgattatggaattaatcagcaaatgtagaagaatatattcaaagttaaaattcagtggcagcacagattatttttatcagagctgtaaagaaaacaactgtccttttctccccaccacccctcctgccccactttggcccagaaaccaaatgtgaacttcctgtctcccacctcagcactagtccatgccaggacaccagctgacaatttcttggttttactgtcaataattgtaccatgtgatcaattactgtcctcacttagaacaaagcctgagtccgagaatatttatattttaccaatatatgcctgttacaagagaaggaaatatgagttatttaagtttaacttttttatgtgaattcagagtttatttatcgagggaaatatgtacaaagaagcttcaaatggaatatttaccgacattccttatacatgacagacacttggctacatgggaagatgatgttaataataaaatgatttttaaatggaaaaaaaacctgtg

SEQ ID NO: 45165 - DNA, 750 bp, Homo sapiens
atttattttgatggcggcggggtgtgcagatgaccctttcctcacaccgtctccgatattggtgttcaccaaaacatctttatccagtagtgcaaaatgtcatgctaaccttgtcttagtttcacgtctttaattctgaaacttgaaacaaaaacaatgcatcagtgggccatggagacttcttcttctgtgtatgggatactgtgtcttttattcttctattctggtatgtcctccctgatttctagtcatttttgaattatttatagacagtaaacattgcccaatatattatgaaaatgtgtttccactttattgttgcctctgaaaacattttgaacagaagcttttataagcaaggcttgaatttttcttttttatgttgtcttaggtttgtgtgagtttccacctttgtgtaacacatttttccttttaacagaaccattttatcactgtctctcttccttcttgggaaaaagaaaaccatctttttcttttcatttgcattacttacaactatgaattgatttatagagtgctaaaatatttgtaaaatcgagcagattcttctgtgtgcctttttctcctggtgatttatttaaatggatttctaaggtgttttcccgtcagtattgatttgttttggtgagtacgattttatgtgcgctatttgtctctctgtttctgaactatagcaacatttttgtgcattctctcttactctccactgaatgatgaacccttgtgaac

SEQ ID NO: 45166 - DNA, 531 bp, Homo sapiens
agagccattctgcttgtaactaggcagttttatatttcatagtctctgccagtggtttctaattttgggccacgaatgctggagaggtatatgaagttgttataagggatttgattatccagatgaacccctatctgcagactgatttgtactggtgttttcagatgtatatagggatttgtgactaatgaagaattatttaaggctggatcagtggttcatgcctgtgatcctagcactttgttaagccagggtgggaggattacttgagcttggggaagtcgcggctgcagtaagccatgtttgtgccatctcgctccagcctgggtgacagagtgagaccctgtctgggaaaaaaaaaaattacttaaaagtacttcctgaattcataaaaatgttttgttattgtattttctttagtgatattaatgaagatccaagacacttaaaaacattccaaaggttcatacacacaaaacttgaaaaacatccttttctaaaaccatgtcaagcaaagcatgatgtagactt

SEQ ID NO: 45167 - DNA, 731 bp, Homo sapiens
tttttcttgagtataggtcacattttcctattatccagatagacactgcgaataacaggctacagaaactcagacttctgctatgttccaccaaagagaagtgccctccactcctgttttagtgcagttaacttggctatagtcaaactacaaacttctcccatacagtaagcggcagctgaaaatcccagttcaattctttcagccttagctggaaatgtggttcaggggtcagccggacttgggggaaggttaaaactgggcccccccgaaccccttccggctctctccctttctaggatttctctttgttgtggctgccctgaggattgcctattccagctttagctgcccagcatgggaaaagactgggaagtgaccacaggcttaacagccatcaggaaataagaaatttccccagtgcaattctcttcttccaaatgccagcccccacctctctggtctccacctgccctttggttactctctagtgtcttcaggtagttcttgtatttttgtccacagtttacacatgttatcaatgggaggactgggcccacagtagctactcagttattaattgttgtagctggacatggtggtgtgcacctacagtcccagctacttaggaggttgaggtgggaggactgcttgagcccaggaatcctaggctgcagtgagctagagtgcaccactgcactccagccagggcaacagactctgtcccttaa

SEQ ID NO: 45168 - DNA, 500 bp, Homo sapiens
tttttcttgagtataggtcacattttcctattatccagatagacactgcgaataacaggctacagaaactcagacttctgctatgttccaccaaagagaagtgccctccactcctgttttagtgcagttaacttggctatagtcaaactacaaacttctcccatacagtaagcggcagctgaaaatcccatgcaattctcttcttccaaatgccagcccccacctctctggtctccacctgccctttggttactctctagtgtcttcaggtagttcttgtatttttgtccacagtttacacatgttatcaatgggaggactgggcccacagtagctactcagttattaattgttgtagctggacatggtggtgtgcacctacagtcccagctacttaggaggttgaggtgggaggactgcttgagcccaggaatcctaggctgcagtgagctagagtgcaccactgcactccagccagggcaacagactctgtcccttaa

SEQ ID NO: 45169 - DNA, 330 bp, Homo sapiens
gcttgcttctgagcaaagcagactggagtatcacttccagagagcccccatggatgaggtctgtgggaggaactggttttccccagcatctgattttcagagcattattctctctccttcagaggttctaagtcaaggatgtggggctgtggtcctaactgcaagtaacagagaatcctctgtgccacactagctggcagtttcccatttcttttaaccccaagcctagcataaaagatccagatctttctatcagctcctaacaccgtgcctggactccctgagcaggcttttttctaaacagaagccagggaagcctgcgagaccttt

SEQ ID NO: 45170 - DNA, 1757 bp, Homo sapiens
  misc_feature (1752)..(1752): n is a, c, g, or t
ctgaagacttgctcagtgaaatggttctgattttttgcttcaaatgatttgcactaattgattttctggagagcggagttatgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtacttgttatacaacaagtgttgcctcttgttttattgaaataaaaactgaaaaaaanaaaaa

SEQ ID NO: 45171 - DNA, 375 bp, Homo sapiens
agatgaaaaaacccaacatccccgaacaaatatctaatcctgtatgtgaaactgaggttttaatttgacttaatttggtttgatcaaactcagaagattaaaacttccaatgagtctagaaaagttcctgaaaagagcccttaaattccaaacaaaggaataactggaaaagcccaaggtcaccagtctagcaaacacagggcgacctttgaatggcccatgtaaaagaacaagttctggtgggttacagtggctcacacctgtaatcccagcactttgggagactaaggctggaagatcacatgaggccaagagttttggaccaacctgggtgacagagaataacattggctcaaaaacaaacaaacaaacaaa

SEQ ID NO: 45172 - DNA, 384 bp, Homo sapiens
attattcttcctaatacttctaaatccagaaggagaaaactgaggggcaccccatccctttcctttcctgacagaggagtagtgaacatgccttttggagagaaaggagtaaaaagcaaaaatggagttcacagaatgggaggaatggtagtaaaagttccagggctatacaattgagtgctccaggacatgttgtcgtaggatggattatatcacaccagcccacctagggataatgagccccatccagaacattcagcagtccttccaaacagaagcagaggaaggatgttatggattgaactgtgacccccaaaattcatatactggggtcctaaccccccagaacctcagaatgtgaccttatttggaaatcagattgtt

SEQ ID NO: 45173 - DNA, 1017 bp, Homo sapiens
ttagctggaactacacttgtgtatcatcatgcccagctaatttttaattttttatttattatttttttaaagagataaggtcttgctctgttgcccaggctggtcttgaactcctaggctccagcaatcctcccacctcagcctccaaagtgcagcctctatatcttgaactccacacctcaaacccagattgtccacatgtgagcacctgtctttttggtttgctgtttctctcgtgagttgtatccagttgcccaaggtggaaagttgggcgtcatccagcaggtaagtcctgacacctccacctccccgatggcttcagaagccagcctcttcttttctgtttcctctgcctctcaacttcctcatccatctaccataagccagaaaaatgacccccaaatgtgaatccgatggtgttctttctgcctgacatctttctttggcttctgctgtggggtaaagtccaagccccttggttccctgtctttcctctctggtctaatcttctattcctctcatcctgtactttgcccttcatcaactctgaactgtttatagttctctgaacatagcccgagtgattcacacatttgcatgtactgttcctctcctgctgtgataaagcgacagtcacctaatccccgcccctccgttgcattttttctttcctacaagatttattatgcacctactgtgtgtatggctctgggatgctgtaataagcaagacagacaccatctttcccttcacggggcgtatgtgtctcgtgcatactgggagggcagggacagggtctccatccatttctgcattccaatgccaagagggtgtcagatctgggtgggtcgaggtagggaacaggtaaacataactcacagtgtgatgccgtgttacagccaggctgggttcctcacgcctgtgatggcagcgctttggggagccaaagtgggaggattgcttgaagccaggagtttgagaccagcctaggcaacatagagagacccgctctcaaaa

SEQ ID NO: 45174 - DNA, 318 bp, Homo sapiens
tggggaatttccctttttcccttcatgtcctaatagggaagcctccctttatccttattcaaccttcactgactttcttcagacagcttagctaaacttccttatcttttctggttgaaatatcctctctctgggtgatgatttatgtgcacacagagctgataaatggctcttcagtttgatgtttatgtaagtatccctttactgaaatttttgagagtcatcaataggtctgattccttggacagtgatccattgagtctagactagagcaacactagagcttgtaaggattcagctgatgtccaaaagagaacg

SEQ ID NO: 45175 - DNA, 451 bp, Homo sapiens
ttctagctctcctgcctcctgcttcttcatttaaggagtcttgtggttacactgggaccacctgcataactccacggattagcagtcttaattccgtcagctcctattctgcctaccacagtagcctacagctagagtgcattcccagaaccccccgcaaaggcttagagaaataggaacagtagaatgaatctattatgtgcaacctgctcagccccctccccaaccatccccattcaactgaccccactggaggatcctggagtaatctccacacacaaaagctttgaaaaacatattggagatgggccaatcgcacagagttctttggaaagctctggatggaacaggttccctgatatcaaggagaataacacaattctgctgtggtagagcccaggtggcaccacttccccaatagtgatatggtggccataattactacactaag

SEQ ID NO: 45176 - DNA, 1383 bp, Homo sapiens
cataatgagagatcttacaagtgtaataaatgtgacagatttttcagatatcgttcatatattgctattcatcatcgaactcatgctggagagaaaccttataaatgtcatgattgtggcaaggtcttcagtcaagtttcatcctatgcaaaacataggaggattcatacaggagagaaactcacaagtgtgatgattgtggcaaagcgtttacttcacattcacacctcaatagacatcagagaatccatgctggacagaaatcttacaaatgtcatcagtgtggtaaggtcttcagtccgagatcactccttgcagaccatcagacaattccttttggagacagttgtttcaaatgccattagtatagcaagccatcaagcattaattgacattacagttaaatgagcactgacctgagtttgagttgacttaacattgagtttaagcattaattgacattaaactgtttatgttaagaggactgggctgggcactgtggctcacgcctgcaatgccagcactttgagaggccaagactggtaggtcactggaggttaagagtttgagaacagcctggccaacagacgggagccacttttcccagcctgtgttttcatttctattctttctttcttttttcttttttttgtttttgtttttgagatggagtctcttgctctgtcatccaggttggagtgcagtggcatgatcttgactcactacaacctccgcctcccaggttcaagcgatcctcctgcctcagtctcctgactagctgggactacaggtgcatgccaccacacctggataattttttgtatttttagtagagactgggtttcgctgtgttagcctggatggtctcgattttctgatcttatgattcacccacctctacctcccgaagtgctgagattatgggcgtgagccaccgtgactggcctgttttttgtttctttaacaaaaagttatggggatttctatgagtattgtgttgaatctaaatcacattcggttatataatcattgagcaatactaatttttccaatcagtatggattgtatgtgtatttatatgtttttaatcattttgatcaatgtttgtagatttcaaggtacaaacttctcacctttatatgtttattcctaaatatttcttactttaagctctttagcaaatggaagtggtttttaattttattttaaaattatttaatgttaatgtatggaaattcaactaatttttggtgctattattctattctgcaaatacactgaatatgtttattagttccagttgtattttggttgactgtgatattcttcacagatcatgtcatctacaaacaaataaaatttgacttctttctttctgatttg

SEQ ID NO: 45177 - DNA, 422 bp, Homo sapiens
ctcctgtctgagaggaagctgaaagtaggagaacagaggcctggcacctgggcgtggtcctgcctttttccatagtggctgcttgagttccgggagcagtccttcctcaccaccttcagcttcggctgttattcttgcactctgacacccacaatacaatgagtgttcctgtactaaagctcgccagagccaaaaaccattagcaaagtaaatctgctgggggaaaaaatatccagcattccagaaagattagcacacgcagtctccagtgtatgagggagttgcgctccaaaagatagtttcaaaagttggaacttagagcatgttttctcccagaaacaaggttatatatggtggttggatacagaggccagttggccaggctggctacccaataaagcacttgaagaacagccttgcct

SEQ ID NO: 45178 - DNA, 587 bp, Homo sapiens
acatgtgccatgcacactcacgtgtgattacacacgtgcacacaggtacatacagcgcacatgcacataccctcacacattgtgcacacacatttacacacaccatgcacacatgcaattacacacacatgcacacaggtacacacaccacacatgcacacacgccctcacacacttgtgcacacacatttacacacaccatgcccacccacgtaattacacacatgcacacatatgcattcacatgtacacacatgcaaatacactcctgcctacacacagtcatacacatgcacacacatgcacacacaaaaatatatgtacacactcatgcacacaatgcattcacatgcacacatagttacactcacagtacatgcccacttatgcaattacacgtgagtacacacatacactgacacgtgctggctcacacacaggcccctgtgtcagagcccagggatggatccgcaggcccgaggttgaaggtgcccgtgccagtgggcaacgccggggttggcaatcatgatgagtcaggagcaggaggggaacgccgaccgcagttgcgatgccgggcggggtggggc

SEQ ID NO: 45179 - DNA, 84 bp, Homo sapiens
aagtatgcagtaggttcacagaggggatgaggaatcagaattcagtttgggaactttttaacttaataaaaaacaaaagaacac

SEQ ID NO: 45180 - DNA, 285 bp, Homo sapiens
taatgaaatatcgcaataaaatttgtttaaaatgtaattttaaaatttaaaaccacttatcttgaagctatacaaaaataatttctacagaatatttcagagtgctttctagatttctagtagtattcattctcaagtgaattataagttttaaattagaggaattttctataggtttgtagttttagaacagaatcacagacctttaaaatcaggagaatctccagagattatgtagttcaagcatgacataaattcacctctgcctgttcctccattggaatt

SEQ ID NO: 45181 - DNA, 449 bp, Homo sapiens
cctttctgttttctgtgttttcaggatagttaccagtcttgcttctccagatcgcccgtccctgggtctggaggctggaatagatactcaatgttaacacccagccaggggaggtggcagagcctcttctagttagaccgcaagctgcctgtcagaactccccctcctgccagtaagagggaacctacaagcccaggcttggtggctcacacctgtaatcccagcactttgggaggctgagcacagggaggatcacgtgagatcaagagttcaagaccagcctggccaatatgacgaaaccccatctctactaaaaaatacaaaaattagccaggtgttgtggcacatgcccataatcccagctacttgggaggctgaggcaggagaatcgcttgaacccaggaggcagaggttgcagcaagccaagatggtgccactgcactccagcc

SEQ ID NO: 45182 - DNA, 342 bp, Homo sapiens
ttcaacagaccaaaccaaaatgcagtcactcctgctgaagttccatgtcaccaagccaaaagtaagttctctacctgaccttctgagaaatcaggagagtgagagataatagccaaatctccacacaagccagttttagctggcatgataaggaaatcccctctgttttaacctttacaaggaaaggagcttggaaataaccaacttgctttttgtcttttgattctgcttttctcagcccttttctgtctacaaaaccaacctcctctgctcagttcatctgaacacattccactttgtagaatgagatgtcgcccaattctagaatcacaaataaaagcc

SEQ ID NO: 45183 - DNA, 284 bp, Homo sapiens
atacattatgtacaaaatgattgcatatagaactacgtgcctctgatggctgcctggtttaataaactgtgattattgtttttctctctacatttcaagctaccatatgtactgaatttctgggatatatcaatctcaaagctaaacctaataggatatactgactttccatgccacacaaggcttcatgagccatgggaagtagctttggagcgccatggttctagaaagaggattgtcaaagacagacactcaggaaaaaaaaatgttttattgtcttaatg

SEQ ID NO: 45184 - DNA, 370 bp, Homo sapiens
cacctgtatgtgtctgggcacatccctgcatccctttgctggcttctagcctactcacttcaagcatttatcccatgagtttcataaaatcgtagaagaaaagggcttgaggcagtggtggggaaatgataggaaagtcatttctggatgcattctgccatcctgcagatccctaaaccacctctccctctccattccctccctccagagaacagcttctccttgtctcctgtggaatagttccgcccacattcatgggcccttcctgtaccaaaactgtacaggtctctcttgcttaccaaacacttggcaaacaaatgtgccgtccttggaaaaattctgttgaataaaattttctctctttgatcca

SEQ ID NO: 45185 - DNA, 479 bp, Homo sapiens
caaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctggtgcc

SEQ ID NO: 45186 - DNA, 814 bp, Homo sapiens
attccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggtccttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctggtgcc

SEQ ID NO: 45187 - DNA, 745 bp, Homo sapiens
attccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggtccttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaata

SEQ ID NO: 45188 - DNA, 713 bp, Homo sapiens
ctggctgtagggcaggagatcctctagggaatgggcagaatggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggtccttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctggtgcc

SEQ ID NO: 45189 - DNA, 318 bp, Homo sapiens
taagtgtcttaagaagacctttcccctgtaatatttttgtatctctttaattttaatatttcaaacatataggaaaatttcaaaaatagtacaagaaatttccatataccctttacccagatttaccagtttttttgcgttgaccatttaccttatattctcttattctttctctctgaatatattatatataattatttatctaaaccatttaaattgtgtgtgtgtatatatatatatacaccccatttctgtatctctgagtatatataatgtatccaaagatatagaaattgtacatataatgtatatcattta

SEQ ID NO: 45190 - DNA, 437 bp, Homo sapiens
tatcacctgaaggagacccaaccttttgttaaatttccttggtttgaggttcttgtaaacatgccagatgttttgaagttccaaagtcccaactcaagtagttaataaattcctcagagacagttccccacttctcctaacccaggatcccaggtcaggacaaacaagcaatatgcctcccttcccataccttctggggttagtcacagcacatctcatgcttatatttcttggtctcagtccccctattttggtccatgtagatttttttccctttcttgcaagctcagccaagcatttcaggagatgtctgttacattttatgaagcaatccacatattttgtagcaagagagtctttgggctatctagtcaacaatgttgttgaaaactgaagccagatgatattaattcttctattaaaatatttcccacatt

SEQ ID NO: 45191 - DNA, 779 bp, Homo sapiens
tgggcaaggatttgggtgttatttccatttcagagggaggtcactgcgggggagctctgagcaggagtgaggtggcctggtttgcacattaggaagctcagtctggctgctgagtgctggcttagggacagtcaacacctagagcaatcagcagggtgcccgccacatggaagggtccagtcagcgctggctcccgttgttctgttatttccagatgtgatctgtctatggcagccagccctcggagtcattccaggtggcaggcagccccctccccagtgacgagggcctggtagaaagacaggtctgctgagctccttccccaggagctctgagtgggcgcttctcccttccccactctgctgtcaccaagagagcaaatggttcctcacccacctgggccggggatggatccgcacagaggacagaggggtgttttgtgtagagtagtcagagaaggcctttcccataagtgtagaaatgattttctaagcagccataaaaaaagaacaaagtcatgtcctaggtaccagcatggatgcagctggaggccattgtcctcagggaattaatgcagaaacagagcgccaaacactgagcattctcatttataagagggagctacacattgggtacacacggacacaaagatgggaacagaagacgctggggagttcacagtgggggtagaagggagacgggttgaaaacctgcctttcaggtactatgctcagtacctgggtgacaggctcattagaaatctgtaccccagcattagt

SEQ ID NO: 45192 - DNA, 437 bp, Homo sapiens
cgaccgtggtgaagcgcgtctgtaatcccagctactcgggaggcttaggtgggaggatcacttgatcctgggagtttgagactgcagtgagccgtgatctccgccactgcactccaggctcggcgacacagcaagaccctgatcccctatcccgtttccccgcaaaaaaaaccaccaaggtggagtaagggaagtaagtttgaggaatcaaaggccacccgttccagtgcattgagaaggcaatgttaattctgcgactgaaagtcaacgaccgtttcattaacatgaccccatagatgggatgtttctgggacctatttaagtgcataagcattgtatgagctactgggatttacaaatacaaacacgaactgtgcctccccacaaagatcgtacaatttaatagggaaaatcctccaaagataaaacgcaggtta

SEQ ID NO: 45193 - DNA, 207 bp, Homo sapiens
tttttctttatgctttagaggtacttgctaaatgtccttttaatttgtacttgtgtcgctattgaaataatgttaagcaattaatacacagatttaggttttccaaattccctatggaacacataaatcgttgttaacattttgtttcgatgtcattttaaactacagagtggatccctgttgtatgtgagtagcatgcctaccccc

SEQ ID NO: 45194 - DNA, 1221 bp, Homo sapiens
ttaggaggggcagggagtcgtgtggaagggccactgcagcccggtgcctggcacatagtaggtgctcaggaaatgtggttcttgagcctctgcccttctctttgttgttggttttgcagagtcattaagggagtttactgcagactgtcccccatataagtgtcctgtggcccctgagcctttgcctcagcctctctctctccctgcagtgccctgggaggaatcaactgacagccctttcagtctcccacagtccagccagttaaatcaaggtgttccccttttatagaggagtctcctagagccaaccgcagcatccctgcctttgggagccacctggaatgtgccagctgcagtagccgttccttccacgccccccccccatgctgtctgtggggcttgccactgagtgctccatctccccatgtgctccatcccccggcatctgctgccattggtcctgcctgttgcgttacttctctgtgccctggagcccctcaagcacagaggcctcgaaaggttgatcagacatcctcagcacctggagcggggcctggcacacaagacggcaatgaacggccaaccctagaagttcaccccacaagacctgcagggcgggggctgagtgtccaagaagcctcttgggaagggatggtcttagacctagtggtgtcttcccattctgcagaggcctagggatgtccccaggtccccagagtgggaggggaagggtcagaagtccatggaaataaaacacagggccagctacaaaatttgtggggcccagtgcaaaatgaagatgcaagttcccttgttcaaaaagcagtaaaaaaaaaaacacaaaagttttttcctttcctttgcaatctctttccatctgtcatgatgttttttgtttgctatttaatgtctcactccctggacacaagatactttcagggtgagtgcagacctcacaggtgtgggcacacctgcccccgaccctcctgcctgcatccgggcccctgctgcaggtaacgggtggcagaggttgctgggtgcgggagcaggcagctgaatacccgtcctggggaggcagctgagactctgtgctgccagcatgtgctccattattccaccagactccacttaacacagattcaaagatgacatgaagcatttcaggacagtgaaagcacagcatgaagccctacgcttggggctcccttcttagggcagggc

SEQ ID NO: 45195 - DNA, 1014 bp, Homo sapiens
tgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataataggtgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataatcacagtacaatgatcaaaatcaggaaattaacacagaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatgattggattcagtttaagcaattttggcaagaacaccgtagaagcgatgtcatatttttcttagtgcgttatatcaggaggcacttgccgttgatttgtccccattactgatggtgataattttaattactcggtgaggatgggtgtcccctttgcactgtaataaatgtcttgtgaagatactatgtaaatatcctatttctcctcatcctttgctta

SEQ ID NO: 45196 - DNA, 214 bp, Homo sapiens
gctcctagtccagggttctttggcaagagccctgggctgagagtcaggggacctgggttctggtccagcttgtgtcactagactagctgtgtggttggacacaatctccctgcatcctgagcctcagctgtaccatctattcagggaaaaggttatatctaactctattccagaatgatctaagacatctgctagaactctgaccggtggtgca

SEQ ID NO: 45197 - DNA, 591 bp, Homo sapiens
ggcccctattgtgtactaaatggctgtcactaaatggctgtagcgacatcgtgctggagccagtgggtcatttgggtctagttttcattcttttctttggatctgcttcacagtttaaattaggcccaggacattgtatatggtggtttaagaaggtgactgtaacaggcagatgttgaaagatggaagcagtaggaggaggccaaactgtggaggacaggggtaataactggattggcaaatgggggttgaggagcatggaaggcagcccagtcagaataccttggcagaggctggagggttgtagttgtgtgattgtgatgaaatattaggggtgatggctgggtttggaagagttaagccgttacgaaatttcttcaaagaacattatcaaacaacacatatgtactgctgattaagcaatatcattaatgagcctgctttataatttaaaatgcaagcagatttactttcagtttcagtcatggaaccattgagacactttggggaggcaagtgaaccactgcagttctttctatactggaaggaaaaggaggaaagcaaagttattttgtggttttggagtagttt

SEQ ID NO: 45198 - DNA, 375 bp, Homo sapiens
caggctctagagcagatgtgatattccagcaagggtgacccagctcatctttcacagattcagaaatgagacacatagatgagtttactctaaactgcacttaaactttcctgtagtcattgctttctctccctgcccctgccccttctgtggaagttgaagcagactaattgtatatcatcttttgttgaacagcgacatcgtgctggagccagtgggtcatttgggtctagttttcattcttttctttggatctgcttcacagtttaaattaggcccaggacattgtatatggtggtttaagaaggtgactgtaacaggcagatgttgaaagatggaagcagtaggaggaggccaaactgtggaggacagggg

SEQ ID NO: 45199 - DNA, 385 bp, Homo sapiens
ctggagcctaccctccagagcttgtacagacattcattaccgacttacagacatagggtatgtgtgcatgtgcctgagatgcttcatctcatactgaccacagacacttccccgcatgtcttcataatgatcatctcttgtggctacacagtgttccctccagttgctatgtgctgattttattaactattcctactctgttggacattcatattgtttgcatgaatacttcatagtctttggcacgttactcaactgcttttcaaatgaattgtcccagtttacagagcaaccagcaacatgtgagtgaatgggcctgtgccatgaaaatctcaccaccatcgtctatatgtttttatcatttctattcatttaataggttaaa

SEQ ID NO: 45200 - DNA, 439 bp, Homo sapiens
gcagcctgggcaacatagtgagacccccgtctctacacgaaagtggcacacacctgtagtccaagctactcgggaggctgaggcgagaggattgcttgagcccaggatgtcaaggctgcagtgagctatgattgcctcactgcactctagcctggggaacagagtgagaccctgtctctaaacataaataaataaacaaacagagaaatgaaggagagggagatattgtacataaaagaatttaagaaaattcaagaaattttctcagaacaaatgacatgagaatacgattgaaagacccagcaacggaaacagatcaatggccatgcgcatggctcatgcctgtaatcccagcattttgggaagccaaggcaggaggatcgcttgagcccaggagttcaagaccagcctggaaaacataatgagaacctgcctctaa

SEQ ID NO: 45201 - DNA, 252 bp, Homo sapiens
atggtgtatatgtgccacattttcattatccagatattatgctttcaaaacaggcatgaacgactcttgttttggagcagtgttaaaccagttccattaaaaatatcatgaagcatgcagaaaggagatgtctacaatattgggatgtgtacattacaatatgtgagagcaaatatgttgaaacagctatgaagtcctaaacattatttcctattaactagagaggtcacttcattttcgacccaacagaga

SEQ ID NO: 45202 - DNA, 3818 bp, Homo sapiens
gagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggtggaaccaccctgtgtatgcatgaccctgacaagcaggcgccaggacagtcaggaggccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgaggggcgggcctctgtgcccaggagttcccctgtctgtggggtttgaggccaccgaggtgctgcagggtggggttgtgcctcccttcagagggggtccgggtgtcagaggagggcacagaccccagagcaggcccaggagaggaggatggggctgccttccaggttccactggactttgctgacggcaggtggctcatgagtcgccatctgccctgactcacagatatgttcccatcctggtagcccagggtccccgggataccgcctggccccgctgagtgccatggatgatgggggtccttcttcagctcagcctcgcctgggccggcctgtggctcccattttcctttcagcgggacaaaggggacttgttaccaggccattctctggatggcctgtgagatctctgcccctccaagaccctccaagtctgagcctgacccacagctgggacactgaattcagccctgggaaccatgggggcttctatcaggcgctagacccccagcccttcccctggcactaccttgggaaccagggtggggtgtggggcctgggctgcccgggagcactcagcccgcctggccctctcttgggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45203 - DNA, 3776 bp, Homo sapiens
gagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgaggggcgggcctctgtgcccaggagttcccctgtctgtggggtttgaggccaccgaggtgctgcagggtggggttgtgcctcccttcagagggggtccgggtgtcagaggagggcacagaccccagagcaggcccaggagaggaggatggggctgccttccaggttccactggactttgctgacggcaggtggctcatgagtcgccatctgccctgactcacagatatgttcccatcctggtagcccagggtccccgggataccgcctggccccgctgagtgccatggatgatgggggtccttcttcagctcagcctcgcctgggccggcctgtggctcccattttcctttcagcgggacaaaggggacttgttaccaggccattctctggatggcctgtgagatctctgcccctccaagaccctccaagtctgagcctgacccacagctgggacactgaattcagccctgggaaccatgggggcttctatcaggcgctagacccccagcccttcccctggcactaccttgggaaccagggtggggtgtggggcctgggctgcccgggagcactcagcccgcctggccctctcttgggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45204 - DNA, 3230 bp, Homo sapiens
gagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacaggtacctgctgagtgaaaaagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacaacagccagaaatgtctccagactctgcccagcctccccaggtagccaccctcgagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45205 - DNA, 2315 bp, Homo sapiens
agctgtcttgagccccaagcctcttcctcccctgctgcccctctgcagccattcgggatgggaccccctctggggtgtcagcacgaaagggctaacgggagccccttccttggcctccccctgtaggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacaacagccagaaatgtctccagactctgcccagcctccccaggtagccaccctcgagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45206 - DNA, 423 bp, Homo sapiens
atgacaaattgtaggccaattggaaggcctagaagcaagatgtgaaaaacaatgtgagttccacagcagccgcccgactgggacacatgcgtggctggtcccaggttcgccccagccctgtgtgcccggagtctcccctgagtacccgaagtccttaacaaaacaggccaggacggtggcttctgagctgctcctctggaggcgatgaaaacaccctcttctccaggggctcagcctgcaccagggtggggtttctgagaggcccctcctcacccgaggggtgccgctgaggggcctggccacactccccctgtctttgcaggacgctgctgaccggggcggtgggctccctgctcctggaatggtacggctggcagagcatcttctatttctccggcggcctcaccttgctttgggtgtggt

SEQ ID NO: 45207 - DNA, 507 bp, Homo sapiens
agggaggctggcgcccatgtgcaacctgaggcatggacgaggcctgctgacccctctggaaccacccccaaatccccaatcctttggcaacgggtggcgcctcccgccctgatagccatcagtttgaaaccgttgctccctcagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaaggtgagtcgggggctcccgcagggtgaaggagcgcccagaaggcacgaggcttgagctgcaccaggcactgtgggtccttggcctgcagatggtggaaccctcggctcctcctggactctgagggtcctggcactgccaggctcttcctctggagaggaccccgtccatg

SEQ ID NO: 45208 - DNA, 3798 bp, Homo sapiens
gaggtggaaggaagtgagtgccctgtccttcctccctgccatgagattccaggaccggacctggcaagtgccctatcccagccagtgttcctggggctcttccaggcagggctatgttccccaggccaggggcattgtcctggacagtcaggaggcatacccctcgccaggtggaaccaccctgtgtatgcatgaccctgacaagcaggcgccaggacagtcaggaggccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgaggggcgggcctctgtgcccaggagttcccctgtctgtggggtttgaggccaccgaggtgctgcagggtggggttgtgcctcccttcagagggggtccgggtgtcagaggagggcacagaccccagagcaggcccaggagaggaggatggggctgccttccaggttccactggactttgctgacggcaggtggctcatgagtcgccatctgccctgactcacagatatgttcccatcctggtagcccagggtccccgggataccgcctggccccgctgagtgccatggatgatgggggtccttcttcagctcagcctcgcctgggccggcctgtggctcccattttcctttcagcgggacaaaggggacttgttaccaggccattctctggatggcctgtgagatctctgcccctccaagaccctccaagtctgagcctgacccacagctgggacactgaattcagccctgggaaccatgggggcttctatcaggcgctagacccccagcccttcccctggcactaccttgggaaccagggtggggtgtggggcctgggctgcccgggagcactcagcccgcctggccctctcttgggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45209 - DNA, 3272 bp, Homo sapiens
gagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggtggaaccaccctgtgtatgcatgaccctgacaagcaggcgccaggacagtcaggaggccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacaacagccagaaatgtctccagactctgcccagcctccccaggtagccaccctcgagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45210 - DNA, 3218 bp, Homo sapiens
gagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggtggaaccaccctgtgtatgcatgaccctgacaagcaggcgccaggacagtcaggaggccaggcccgagtgccaggcatggacggggacgctgctgctgggcacgtgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggggtttacttccctgccctgaccagcctgctgtcgcagaaggtgcgggagagtgagcgagccttcacctacagcatcgtgggcgccggctcccagtttgggacgctgctgaccggggcggtgggctccctgctcctggaatggtacggctggcagagcatcttctatttctccggcggcctcaccttgctttgggtgtggtacgtgtacagatctcatcctggccttgggtgtcctggcccaaagccggccggtgtccaggcacagcagagtcccctggagacggctcttccggaagcctgctgtctgggcagccgtcgtctcccagctctctgcagcctgctccttcttcatcctcctctcctggctgcccaccttcttcgaggagaccttccccgacgccaagggctggatcttcaacgtggttccttggttggtggcgattccggccagtctattcagcgggtttctctctgatcatctcatcaatcagggttacagagccatcacggtgcggaagctcatgcagggcatgggccttggcctctccagcgtctttgctctgtgcctgggccacacctccagcttctgtgagtctgtggtctttgcatcagcctccatcggcctccagaccttcaaccacagtggcatttctgttaacatccaggacttggccccgtcctgcgccggctttctgtttggtgtggccaacacagccggggccttggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccgggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccatccctagccagcagctcccagtcagacaacagccagaaatgtctccagactctgcccagcctccccaggtagccaccctcgagacatgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgttgcctgaggagctggtggtttcatgagttaatgatacatcttgcaaggtgtacacatagagaaaaaaacctaaaaatgtggaaaagcacgccaaagccttatttaaataataactattaaactattcaaaaaggaaaaaaaaaaaacaaacaaaaaacataaaaacaaaaaaacaaaaagaaaaaaaaaaaaaacaaaacaggggggcgggcgcgccccagaagaaatcccgcccgcggggggcggccccaataaccgcgcgaccacccggcttccttgttagcacacaacaggggggggcgccccacaagaacgagcgagcgcaccgtagtcataactatacgcagcgcgagctccgatggccgcgcccacacacctcaaccacacagtcgtgggtacaccctgcggcaaccaaacgctggccacaacccggcggaaacatcttgcgtggagagaaaggcgacccgctcacactaccccagcgagagcgagggacggcaacccaaacatcggtgtgggggccgccgacaaacctccctcactcctcaaccatgcgcgacgatcttcattaccaaatcgcccccctcgctcgacgggcggcgacgaatcgctcatcacacacaatccatcttattcacacggccgtcgcgctatcctccacgcgtgtgtggtgcctcatcacaccgaacgacgggtcgcatcaataatatgtcgacccggcccgcgctagctcgtcaggaaaatgaagatttcgtgctggctcaatcttaggaggcagaaattgcactcgatcgttcgtcgctgacgaacacacatttctttctcc

SEQ ID NO: 45211 - DNA, 269 bp, Homo sapiens
tgcaaacggtcgttctagacggatcccagcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45212 - DNA, 665 bp, Homo sapiens
gtattcatgagaacactctcttaattttccaccgctacagagctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaatgctggccgtttccctttatagagggaatattacatgaccacagaatcaattaactcgatggactatgga

SEQ ID NO: 45213 - DNA, 333 bp, Homo sapiens
gcctactactactaaaaacccggcggtcgactgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtaaaagcatggtggtaaaagaaactaataacttcactaatttgtaaaaccaatcttacgttaagaattgattatttcgagaccagcctatgcaacatggtgagatcctgtctctacaaaaaataaaaaaatttaaccaggcctggtgatacacatctgtggt

SEQ ID NO: 45214 - DNA, 4435 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45215 - DNA, 5039 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggaatccccaggcgggggagcacgcgaatttgacgcgagctcaccccctcgttttgtgttgatacaagaggggcgcgcccaatagagggggcgaggcaagttaaaataaaaacacgcacggcgcgggcgggcgtttaatacaaacacgctcgcggaggggagaaaacacacgtatagcttcaggtaaccttaccttagaggaggaaaagacccccccactctgtggggcgggggaaggagaattgcgcgggacaccccacacaacaagaatataacgcccgccgggaggaatcaatcaaccgagagcggcggccgagggggtgacccccccggccaacattctcggcggcgagagaaacattcgtcccccgggtcattattattaataattttcaggcgagcttgataatatataaatggacgacaaccacaaaacacgcagaagacagaactacagcgaagtgcacgcaggcgccagcagccgacgcgaccatcccgcacggcacc

SEQ ID NO: 45216 - DNA, 4464 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaacagaaacaagaagaaaaaaaaa

SEQ ID NO: 45217 - DNA, 4469 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaagggggatcctcgtagagcgacctcagcatcactg

SEQ ID NO: 45218 - DNA, 4428 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaggttcaatggttgatattgctagttattatcgaaaccactcagcctactcatttcaacccatg

SEQ ID NO: 45219 - DNA, 4218 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccataaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45220 - DNA, 4380 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45221 - DNA, 4222 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaaactttgattcttgaaagagaaaacaaaagcatgtgaataaactttgaagtgttcacctcagtttgggaccaaactgcttggttctttgtaaaaaccggttttgtatgtcaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45222 - DNA, 5086 bp, Homo sapiens
  misc_feature (354)..(354): n is a, c, g, or t
  misc_feature (366)..(366): n is a, c, g, or t
  misc_feature (368)..(368): n is a, c, g, or t
  misc_feature (372)..(372): n is a, c, g, or t
  misc_feature (374)..(375): n is a, c, g, or t
  misc_feature (381)..(382): n is a, c, g, or t
  misc_feature (389)..(390): n is a, c, g, or t
  misc_feature (392)..(392): n is a, c, g, or t
  misc_feature (404)..(404): n is a, c, g, or t
  misc_feature (408)..(409): n is a, c, g, or t
  misc_feature (412)..(412): n is a, c, g, or t
  misc_feature (414)..(414): n is a, c, g, or t
  misc_feature (419)..(419): n is a, c, g, or t
  misc_feature (425)..(425): n is a, c, g, or t
  misc_feature (427)..(427): n is a, c, g, or t
  misc_feature (432)..(432): n is a, c, g, or t
  misc_feature (438)..(438): n is a, c, g, or t
  misc_feature (451)..(451): n is a, c, g, or t
  misc_feature (453)..(454): n is a, c, g, or t
  misc_feature (456)..(456): n is a, c, g, or t
  misc_feature (461)..(463): n is a, c, g, or t
  misc_feature (475)..(475): n is a, c, g, or t
  misc_feature (484)..(485): n is a, c, g, or t
  misc_feature (495)..(496): n is a, c, g, or t
  misc_feature (499)..(500): n is a, c, g, or t
  misc_feature (502)..(503): n is a, c, g, or t
  misc_feature (507)..(507): n is a, c, g, or t
  misc_feature (531)..(532): n is a, c, g, or t
  misc_feature (539)..(539): n is a, c, g, or t
  misc_feature (542)..(543): n is a, c, g, or t
  misc_feature (546)..(546): n is a, c, g, or t
  misc_feature (552)..(552): n is a, c, g, or t
  misc_feature (558)..(558): n is a, c, g, or t
  misc_feature (563)..(563): n is a, c, g, or t
  misc_feature (566)..(567): n is a, c, g, or t
  misc_feature (573)..(573): n is a, c, g, or t
  misc_feature (592)..(592): n is a, c, g, or t
  misc_feature (596)..(596): n is a, c, g, or t
  misc_feature (600)..(600): n is a, c, g, or t
  misc_feature (615)..(615): n is a, c, g, or t
  misc_feature (624)..(624): n is a, c, g, or t
  misc_feature (628)..(628): n is a, c, g, or t
agagacagggtctcactatgttacccagactggtctcaaaactcctgagctcaagtgatcctccccgcttggcctcccaaagtgttgggattacaggtgtgagccaccacacccggcctgacaagccttttttcagccagaaaacaaaacaaggaaatggtttacctttttaggaagggggcttcctcgatgggcacattcttcttctgcctgacggccacgctttattcctggaagctcatgggtcaatctgggtattactttttctccatctgaaaagagcagtttagcctgaagggaaaaagaccaagtgttaccagtcactattttggtgggtaagcacaccctacctantttttttttttntngagncnnagtctnnctctgtnncncaggctggagtncagnngcncnatctnggctcncngcaanctccanctcctgggttcangnnantctcnnncctcagcctccngagtagctnngactacaggnnccnncnnccangcctggctaatttttgtatttttnntagaganggnnttncaccanattagncaggntgnnctcganctcctgacctcgtgatccncccncctnggcctcccaaagtgntgggattanaggngtgagccaccatgcccggccaagatctgctaaaattaattgtcatggttttacttctggtggctgtggaagctacttattttctttggatgtcattagatgtcttagctcttgaaaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45223 - DNA, 4054 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccgggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45224 - DNA, 4830 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagagcataaactttctttagactactctgcaatgatgttttcacatttaaaatttgccttggattctaccaatgtaagccaaagaacagtagagatttgtgggtcagctatcaaaaaaaagtatggtctttgccaaaatgaatggccattggagctcttagaccctctagcacccaccatctactatgttcgatctgcatcagcctatcatggtgaagagctgcaccctcaataccctccagttgaggagactgggcagaatgggaaaggccaaggcatagtccaggaaggccttgttttaaaaccacaaggtgggtgtatgtcccagtagaagccaacacggctgcgtgttaggagaggacatgacagtgcttccgtctttctcccctgggggacacggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45225 - DNA, 4567 bp, Homo sapiens
gcggagacgctgggcgcgctgtggggcgggggcgaggttcgggctggttgttccgttgcgagctgcagctgcgatctctgtggtaggcccagcctggtggccaaaaacgggatagtccaaatttgtctcctacgggaatattagagttctcacttttttcttgggctggagctgaggccggcttgcattccagtggcaatcggcgtgagttctgcttatatgagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45226 - DNA, 4487 bp, Homo sapiens
gcggagacgctgggcgcgctgtggggcgggggcgaggttcgggctggttgttccgttgcgagctgcagctgcgatctctgtggtaggcccaggtcaagagtcttcatctccagctgcctcagttttcttatcactaaaacagcaaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45227 - DNA, 4059 bp, Homo sapiens
cggacgcgtgggtcgacccacgcgtccggagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45228 - DNA, 4378 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggaagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45229 - DNA, 2436 bp, Homo sapiens
cctaattttagaagtttcaatagcagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45230 - DNA, 2923 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatatgaccgtgaagcgaaggcagtacgttcctcatcccgactcctctact

SEQ ID NO: 45231 - DNA, 2129 bp, Homo sapiens
tgcagtgcgactgctgagaggatgccccctgggctgctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45232 - DNA, 2461 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggatgggcataattctaaaaatgaactacaaagggttaatttttattaaatgtatcaacaacctttgtgaagtggttagaatatggtaaatgaccccaaagtctattgaggtgagcttgag

SEQ ID NO: 45233 - DNA, 1606 bp, Homo sapiens
cccgccgtaccagttgcgacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45234 - DNA, 2385 bp, Homo sapiens
gcggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggtgaactgttgatttgatcagtaattccaacaaaatgagtgcgt

SEQ ID NO: 45235 - DNA, 300 bp, Homo sapiens
caaagcaagcacaaggacccatttaagaggatgtttccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45236 - DNA, 161 bp, Homo sapiens
tcccgaagccgatctctctctcgttcaaggaagcgcaggctgaggtaagggggtgtgactttgtatattgagataatcattgcatcagtcgatgtggatgtttgaagatcttttgttagacttttcctgtgagtgtcaaatggactggggggttggcttga

SEQ ID NO: 45237 - DNA, 229 bp, Homo sapiens
tggggcgggggcgaggttcgggctggttgttccgttgcgagctgcagctgcgatctctgtggtaggcccaggtgagtgagcgcctctgatggaagttagggcagcttaaccggctctagtggtttcgtctcttatcttttttccccagctgctggtcaggggctcggggaaggcctggcgtggagtcgctccccccagcttacaccctggcctcttctgagcgggctcc

SEQ ID NO: 45238 - DNA, 418 bp, Homo sapiens
cagtttcgagccagaggaagaggctggggcagaggcaactactctgggaacaataacaacaacagcaacaacgattttcaaaaaagaaaccgggaagaggagtgggacccagagtacacacccaaaagcaagaagtattacttggtatgtgtctggggataaccaggaagggttagagggcctttgacacacagagtagctgataccaagccttaattagtttgtccaaaactgcgattaaatgtacgtgcaggattattgcactggggcatgtgtacttgcatagtgctaactagatgggtgtcctctagagaggcagtcctggtcttcaaagggtttatcactgaagatgtttgtggattccaagataagcaagaagcattggtcttgtctttttagtctatgaacttgttttact

SEQ ID NO: 45239 - DNA, 4821 bp, Homo sapiens
tgaccatgttcatagatctgggaatagacaactggagcagaagggaatttttgtgcttttatgggtaggtacggagagttactttaccttgaaatgcatttgttaaattcattttaatatacttctgttcattgctttcttattttaaacatctgatttttgtcaggttcaccaggttgagttttgtggagcttgtgaattagtcttgcataatgaaaaccttagcacctgaaatattgccagtgaaagtatcaggttacagtaaggaaggcttttgctttccatactgtaggaggttagatgaatgaaaacctgtcagacagaggcagaccatctcatactttgagagaaaagcttgggtccttttggagtaaagctgagggctaaagtagggtttgtgtttatagattttgagcatcagtaacagaatctgcatttgggtagccattttatcactacttattttctctcatttcagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45240 - DNA, 4548 bp, Homo sapiens
gcggagacgctgggcgcgctgtggggcgggggcgaggttcgggctggttgttccgttgcgagctgcagctgcgatctctgtggtaggcccaggctggagtgcagtggtgcagtcatagcttactactgcccctcaaactcctgggcttgaaaggtgactcctgatcctgagaggatcgagtgatccttccacctcagcttcacaaaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45241 - DNA, 4005 bp, Homo sapiens
cagatgatctacaggaccttagctcactgaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45242 - DNA, 3794 bp, Homo sapiens
ctttagaagacttgagcatgagctctgcttttccataagaaagagaatgatgatttttgctgctgtcaccctctcccccattaacatgtattttgtttttatttgtgttcacagtatatttcgtatttagatcttctaggtgacttgaagcaaatttgaagtctctttttagacttgtatttccaaatgtgagttgtataaaagcaaaacagtccaaggttgaacattctatgttaactttgctgaaagcagattttaagtgactgagtgaaggttgggtaagaccttaagttattttttgccctagatcacattacaggtaagtaggtttttgtttttgtttttgagtatcctaaaaataacttttgttgttctctttggttgcttttgtaagacacaactccatggatcatatatttttctcttaattgccaagttcatagaactgtgaatggcagttttcagaaattattacgaagtaaccgcatagaaagtcctttggtaatacaggaatccataagacatgtttttttcagagaatcaaaaaccaaaaacggtaaggcactattttagagcatgctgttaagaagcctcttgtgtctctctcttgtgtttttataaataggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45243 - DNA, 2646 bp, Homo sapiens
tggtgcgatctcagctcactgcaacctccacctcctgggtttaagcgattcttctgctttagcctccctagtagctgggattacaggcacacgccaccttgctcggctgatttttgtatttttagtagagaacagggttttggttgttgcccatgctggtcttgaactcctgagctcaagtgatccgcctgcctcggcctcccaaagttctgggattacaggcgtgagccactgcacctggccagccttctcaacttctaaactagccagagtcattactgggccagaaaggaaacaaagtgagatcaatgcatagcattttcagaaggccagcatcattgttttggaggactggcgtgggttctgtgagggatccttatggagtaacttctgtgggacatcctgcatcccttccaagcttgggtgagatgcctcacatttcccagtgcttcctctgcacccctccattggagtaaaaaccacagtttgtgggatggttgagttgacagctctgaatcccagaaaccttaattttggcttatcttttgataggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45244 - DNA, 1970 bp, Homo sapiens
gctgcaggtgtggccctaaaaaaaagacacacaaaaaaaggaaattttaaaaaatgactatcaaaaaatgtattcagttgtagaagcaaattccactgaagaatggatggacaaatggggcttggaggattttgtcagtatgatgtaaaacctgtatagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctccttttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgggttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaa

SEQ ID NO: 45245 - DNA, 536 bp, Homo sapiens
ggctgccggggataaccagggagatgaggtcaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggcaagtatctcatttcccctgcctggttgtgtttttatctcactagctggcagtttaattgtaatgtg

SEQ ID NO: 45246 - DNA, 3829 bp, Homo sapiens
  misc_feature (1047)..(1047): n is a, c, g, or t
  misc_feature (1949)..(1949): n is a, c, g, or t
  misc_feature (2868)..(2868): n is a, c, g, or t
  misc_feature (3095)..(3095): n is a, c, g, or t
ctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcgatggagacctaatccaaatggaagggagtccgcccgagacccaggagagcaagaggccctccagcctgggctgctgctaactggngcctgcgtggaaggcctccgctccctgcacacacacggacaggaatttccgtgactgtggtgcggagactggagcccaagctctgcagcgtgtcgccctcaagctgtaggcccgtgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggacgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacanctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggctcctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggagtgcaatggcacgatcttggctcactgcaagcttccccttccgggttcatgccattctcctgcctcagcctcccgagtagctgggactacaggcacgtgtgaccatgccnggctaattttttatatttttagtagagagaggtttcaccatgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccnccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatattacctcca

SEQ ID NO: 45247 - DNA, 474 bp, Homo sapiens
gtagagactgaggtttcactttgttgcccaggctggtctcaacctcctgggcccaagtgatcctcccaccttggcctcccaaagtgctgggattacaggcatgagccactgcacccagcctggatctgatgaaaagttaggtggaaactcatgggtgaatccccaggtatttgcacagctccttaactgtctttctcctggttgggtccacaggactgtggaagaatgaggtcctccctgacacctttggggccccctgtgagccgcgaccgtgtcatcgccagcttccctaaggtagagagtcattacgtctgcagtgctctcctggccctgcagccacatcagctctccccactctacactcatgcctagaagtaaagcaggtgaatcaaggaggtctgtccattgtcagatttaccttgaggagctgggagactggtcactgactgcccaaggtgggaccgcaagttaatg

SEQ ID NO: 45248 - DNA, 914 bp, Homo sapiens
ctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccagggtgagcaacatgccacgtcggggctcaactgcatgcagcagcggggtccctgccgggctccacagtgggaatcccgagttctctgcacaggcaccagttttttgtcctccaagacccactgagaaaacaccaggccactgcttgggaacagggaagctgccttcatccccaggcactggctgactttggcgatcacaccctttaaggaccctgtggtagtgggtgctggctttaagtctcagccccagtttcagctcataaagatgctcagagatgaaaaaa

SEQ ID NO: 45249 - DNA, 696 bp, Homo sapiens
ggcaggcacatatctgtcctgagttccacatcttccaacacttgggccatagtagcatctgattggaagagtagatgctgggaagcaaaggctcagaagtttgagggagtggcccaagcaggcagtggggtgggagttgggaggctggagccaggtgggaggccaggccagtggaccctgcccctggcactgtgctgcctgtgtgagtgggtggggctgtgccctcctggggtcattgttactgtcagggtgctctagaaagggctacgtgccaacctgagggtaggctagcctggctttcacacccagatgcattaaggggcaaggagaaacactgatgaggtcccggctgtcttgtgggcccacaggcgagaacgtgaaggcattcttcagccgcgtagccgccctggcattcgagcagtcggtgctgcaggacctggagaggcagagcagtgcccggctccaggtcggcgatggagacctaatccgtgagtataggtgtgactgggttgggctggggagtaggctggaggcctaaaatccacatgcgccatcctcgtcacctgaggccttgccatttcctgaacttgtggccctctcctgtcctttgaccctcctctcagggtgtcactgcagcctcaggcctgtagcccctctgattccacctgccaggtcagacaccctccctagccctcc

SEQ ID NO: 45250 - DNA, 3769 bp, Homo sapiens
  misc_feature (1047)..(1047): n is a, c, g, or t
  misc_feature (1949)..(1949): n is a, c, g, or t
  misc_feature (2868)..(2868): n is a, c, g, or t
  misc_feature (3095)..(3095): n is a, c, g, or t
ctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcgatggagacctaatccaaatggaagggagtccgcccgagacccaggagagcaagaggccctccagcctgggctgctgctaactggngcctgcgtggaaggcctccgctccctgcacacacacggacaggaatttccgtgactgtggtgcggagactggagcccaagctctgcagcgtgtcgccctcaagctgtaggcccgtgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggacgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacanctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggctcctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggagtgcaatggcacgatcttggctcactgcaagcttccccttccgggttcatgccattctcctgcctcagcctcccgagtagctgggactacaggcacgtgtgaccatgccnggctaattttttatatttttagtagagagaggtttcaccatgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccnccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatattacctcca

SEQ ID NO: 45251 - DNA, 467 bp, Homo sapiens
ctttgcattgctttggcagaggagctgaaggtgcctttgggtggagatcgatgaaccgtaatctgagctagggttttagatcttgacctgtcatttaggaaagtgcatgtgtaaattgaggtctctgtggtttcttggtcttgggcaggttactgttttcactgtcatcactggtgttagtgagggtcctgccaggatagcgagtaccagtggtataatgcccagacctctaggagctgcttcgggccaacaatccagcccagtttgttactcggtcttcctgctgtcccaggggtcatctgacaacatttctagggaaactgggtgatcagaatatgaaccccatgtccctttctggaagtcagtccttgattttgttctgcatcctgcttctcactctaccaggcctctctctgctggttctgtttctcacagaaagcaacctgtctgtagagaactggtagagg

SEQ ID NO: 45252 - DNA, 410 bp, Homo sapiens
cactgcactccagcctggttgacacagtgagaccctgcctcaaagaacaaaaaacaaaggaagcagaagcagcagcagaagttgtcatgtatccacattaatagtccatatattgctggctcacatttctcacctagagacataggaccttaacaccttccccctaacctgttgcccattttttctgagtccagtaagtgtcttaacgtgtgctcacagctcccctgctcattgatgtctactgccaccagcctttgaagaggcttctgctgcaggagctgtgccttcctcagtgagaacacagcttcttccttctaaggtgctgtttttcagcactgtactcttcagcctccctggacaacctgtgttccagactttcgcaactctgggtcactctgtgtcccctgggt

SEQ ID NO: 45253 - DNA, 375 bp, Homo sapiens
atacaaaatatctcattttcactgatagaaaattgcttttaagtgttgatccttagaaatcttatttttttctataaccttagaatttgatcatatgatggtcataggaactttttctgccatgtataaatcacacttggttttgctcaaagaacagcatgaagtggtgaattgtttccatgaaacaattattgagaatgggaatacagtatatctggaaatgacacagtataatacaagttacagtagcatttgtcacaaaaaccacttgtcagcatgtgtaaacttaattttaaagcctattctaatcactcgagtttattattttattgttcgctatgctggttgactcatcttagtttcttcaactaccca

SEQ ID NO: 45254 - DNA, 454 bp, Homo sapiens
actaaactcccaagtcattccacattaatgaggtgttagagatttcaattagcacacacttgaattagtaaaaggattaagtactccatttattcttctgcctggatgataatagtagtttctgtttattaaattcttactgtataccagggactgtgcaaaatgctttacttacagcctcttgattagtcaccaagtattattggccttacttcttagcaaaaaccaaagctcagagagattacaacacttgcccacggtcgctcagctatacatagtggagccaagagtttagtcaggtttagtgttagtccaaatcctatgtcctgtgttcagtgatatcttcatggagatgctttataaactatgcattatttctattaagccaatctataaacacactgggaacagattccatgtttcctttaaaaattacttttaccttctttgtcaa

SEQ ID NO: 45255 - DNA, 1333 bp, Homo sapiens
gcaagttgcttctgtagtgactataaatagtttaatgagtactttgacttactgtgattcgaagctaaaaatctgtgattgtagaatcaaagggttgtttttaaaacatgcaaagcggtcagctgctgtggctctatccagaaggtgaagctaccgtaaaagaagatgctagatgtgccttcttgggtttgagcatctcactgaaggtggttcttagtgccatggaaagtgggcaggggtcatttaccttttcacctttgttcctgggtagtcaggatgatttcctttccctaaatgatactacagagcctttgaaatcatattctgtagtctaggactgtccagttccaagatcaggatatgttttgttgcctgtttctagagatttggagtactcttaattaaatataatctatactctgcatggaattttacatgattttcattatctggaagtgacactactgatttgtctcatcatcattgtcctgataacactagctgccactattatgctagacatgttaccagcctgcgtgcgacttctcactcagaggtcacagctaggatgtgtgcatctggggccctagtctggtccatggccgaggccactgtctttctaatgcagcgtgcataccgctctccttctggattcacctctccattcttccttctgaccagaaacacacatttgggggtggctacgtctttagggtgctacttaaaacagcagactgagttgaagcacagctttgccacagggcctttgtctcattgtcactctgtgtgactaacctgtgtaatcattgtgttgtcatcagtacctgtataaaaacaggatctgtttgggattaccagaagcttcttaatgacagtgtcttctcatgaatgtagtgtatattttttacagtttatttttgcctatctttttgttttaaaaactttcaaacctgcataaaacttaaaataagaggataattaattcctgaatacctttacccagaatcgccagttgctagccattggctacattctggcactgtattctttccttaatacaagaaatacagaggtgaaagaagcctaggagatagttttattattaaaattagggtgattagcctgagcagcatgatgaggccctgtctctaccaaaaataaataaataaaaaaatacagaaattagccggttagtacacatgcctgtagtctcagctacttaggaggctgaggtgggaggatcacttgggcctgggagttggaggctgcagtgagctgagatcatgccatatcactacactccagcctgggtgacagagacagaccctatctc

SEQ ID NO: 45256 - DNA, 941 bp, Homo sapiens
gcgccttggtggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagatttgttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaagggaacaacctatgaagaggaaattaataatattaaacatattacttcaaaaattaatgcaattctggctcataattcaccagttttgattgttcaaagatggatacgtggtttcttagttagaaaaaatttgaggtatgttttgttttctttaccatttgaatattgaaataagaaggtgaagaaataaatgataagaagtcaat

SEQ ID NO: 45257 - DNA, 709 bp, Homo sapiens
gcgccttggtggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagatttgttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagggaacaacctatgaagaggaaattaataatattaaacatattacttcaaaaattaatgcaattctggctcataattcaccagttttgattgttcaaagatggatacgtggtttcttagttagaaaaaatttgagactgttacagtcctctgaatttaaggattgcttgaagatgtgtccaagaaagcgagaaaaaaaaaacattttttttctaatttttaagttgatagaaaaatattaatctagtttccttgaaatataaaatctattgaaaataaagaaatgtttcatgttaaac

SEQ ID NO: 45258 - DNA, 951 bp, Homo sapiens
gcgccttggtggcgcccggaaaaccatgatgtggagaacttggatgttgtcttgtttctctagcaacggtctcaggagcagatggccgcccagcgatttgtctgactgtgttggggctgggccacttgtctccaactcataagggcttgcagcccagttgacccgatgtttcatggaacagtcacagaagagctaaccagtcatgaagaatggagtcactataatgaaaacataagagaaggtcaaaaagatttgttttgtgaagttcaatggccttcatttaaagtctatggaaaatttgcagtcttgcatctctcttagagtatgcatcttctcaaacaattttattacagatattcatccacttcaaagttgtataaaattaatcaaacttgatctccatggaaatcagataaagagtctaccaaataccaaattttggaatggattgaagaacctaaaactactctatcttcatgacaatgggtttgcaaagttaaagaatatatgtgtattatctgcctgtccaaccctcattgccctcactatgtttgattgtccagtaagccttaaaaaaggatatagacatgttcttgttaacagtatatggcctctcaaagcgctggatcatcatgtgatttctgatgaagaaataattcagaactggcatcttcctgaaagattcaaagcatgtaaccatcgacttttctttaatttctgcccagctttgagaaaggtaattggcttctttagggtttcattttaattaaatgtataaaagggaaattttagcttctgagttctatatctaaattatataaactttttaatatttttgcatcatttatataaaataatataaaccaatgaatatatttgtaatgtctttctatctgaaacttgataaaagtttgcatgccaactacattaaacaaagcctgaaatgaaaaa

SEQ ID NO: 45259 - DNA, 828 bp, Homo sapiens
ctagcacaggaagcggatgacagaggaatcccctttcctccaggtcaccttggcttgctgagttttccctaaagtaaggacatggttcttgtgcccccaggcagctgttccaggcccccaccccaaggagctcaggactggtcaggtaaaggaaagctgttctcatgtcctttccccacctgtgtgacccctcagtcccacctgtgtgacccctcagtcccaccctgaggcccaggctagtggggccattccacaggatccatgcagcctggccccaataccctaacagggaagggaaaggaagtcgtttggaagttgagacagcaaagatttaattttttttcctacacaaatctttggattcatggggaggattgaacagatggagcttaggctggtttaaagtgaaatagtggccttcccgggagagagacaccttcctgggacggccattccttcaacaagcatttattgagcaccctgcaggggctgcatgctggcccctgcattaccgcagcagtgttgctaactgggttcatgaacgcctgggctctaggcctattttgtcacttcctggtgctgtgaccttggtcagccttctcatggggacagatgaatttcatccacttactcaacaatatttattgagtgcctactgtgtgccaggcaccaataaagagtgcctgggtgccagcattgaatgaaacagaaaaaagtctctacctgcaagaagcgtggttctagcagggaaactaactagaaacaagataaagtaaataaaattagaagtcattaaaacagaaattctagataatacgtgctaaaaag

SEQ ID NO: 45260 - DNA, 544 bp, Homo sapiens
atttccgggctggctctgacagcctctggccccactggagaaggaagccagcactgaaaaaattcaagcttccggccacacggaacctgagaatattctctatgacagcagtggctgtgaagctgtttctttaaagtaaaaccccttttgaaggttagtctggggtgactttactgttacatagggagtagattttgtttcttgatggttcgttgagtggtagagaggttaaaggtagaactaacaaatgtagaactaaaaagcatctgaaacttttagcaaaccagtaatatttagaggcttctgcccactctgggtaggcatttttatcttgtatacccataccagcttttcacatcctgtttcttgagaatacataaagagcagatttctccacattatcaggaaaacaatttgaagcacaggtcttgtgaattgggaagaccactagcattgccattagctgcttatttgtgtgtgtgttggaggatggattataatccaagtgtattcatattctcacactttaaccaaaaaaaaaaaa

SEQ ID NO: 45261 - DNA, 345 bp, Homo sapiens
ggccccgtggctccctctcgcctgcaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggtggcatgcccgtgtatgttggtttagcgttgtccggggtttgtt

SEQ ID NO: 45262 - DNA, 1683 bp, Homo sapiens
  misc_feature (13)..(13): n is a, c, g, or t
catggttcaggtncggttttcccgggatcggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgaaaaaaaaa

SEQ ID NO: 45263 - DNA, 1192 bp, Homo sapiens
cggcacagcagccgccgcgattcgaggcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgaaaaaaaaa

SEQ ID NO: 45264 - DNA, 711 bp, Homo sapiens
aatcttgcactttgaaaccgcgggaccgaggcagggtgcgcgcgtgtggttggtgccttttttttttttcttcccctccctaaacccttctgtcgtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaaggtaccaggcactgcgactccagggagtggggggccgcaggggcgggggtaagcccactgctgccgctgcgggatcccg

SEQ ID NO: 45265 - DNA, 295 bp, Homo sapiens
aatcttgcactttgaaaccgcgggaccgaggcagggtgcgcgcgtgtggttggtgccttttttttttttcttcccctccctaaacccttctgtcgtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttcttttttttttccccccccggggctttgg

SEQ ID NO: 45266 - DNA, 1029 bp, Homo sapiens
gtgagtgcagggtgtgcgcactcctgggtagagctgggagccgcctgctagctggcgcctcgtattttccttggcaacccgctacccagccccaacctgggcggctgcagctctgaagacacgagagagggtacttggtttgggtttgaaaagggaagagcggtcttgtatgcagtagtctggccggaccgacactgagaggcccaggtgtttggaaagcaggaaagaggaggccaggattgttctctggggccggactgagaaatgcctgaaggagacgacggaggagatccggcagatgggcactgagtgccattacttcatctgtgatgtgggcaaccgggaggaggtgtaccagacggccaaggccgtccgggagaagttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgaaaaaaaaa

SEQ ID NO: 45267 - DNA, 1785 bp, Homo sapiens
aatcttgcactttgaaaccgcgggaccgaggcagggtgcgcgcgtgtggttggtgccttttttttttttcttcccctccctaaacccttctgtcgtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtgaaaaaaaaa

SEQ ID NO: 45268 - DNA, 1646 bp, Homo sapiens
aatcttgcactttgaaaccgcgggaccgaggcagggtgcgcgcgtgtggttggtgccttttttttttttcttcccctccctaaacccttctgtcgtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgaccccaacggacggaggcgccgaagcacttgacctttgacattccagtctgtgagttatggcatgcgttcagctcacttccagtgcttacacatcccatgtgtcccccttgc

SEQ ID NO: 45269 - DNA, 945 bp, Homo sapiens
aatcttgcactttgaaaccgcgggaccgaggcagggtgcgcgcgtgtggttggtgccttttttttttttcttcccctccctaaacccttctgtcgtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggccagtgttgatgtgttggacttgaggagggatatatcactggaccggc

SEQ ID NO: 45270 - DNA, 2268 bp, Homo sapiens
ggacgggctaggcagcgcggggagggattcggactcggggcgggcctgcacgagggcatcggctccacagggaccagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45271 - DNA, 2186 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45272 - DNA, 2099 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45273 - DNA, 2502 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccaggtcagcccgggggcagagagcggtggtggattgagagaggagacaggaccttgccctgggggatctggggcttcttaagggacagagccagtctaagggaggagttggggtgtcgtggtcacgctgggaactcgtggccactggtaccccccacagcaagcaggcgctggtgttccagtgtgtgggctgcggggccttccaccttcagcgtctcggcaaagcgtcaggagtccccagcggccggtgagcagggaggaaggagaagaaggggagtcccagggttttcctccctccccaccaaccacccctctctgtttagggccaagttctctgcagcctgtggtccccctgtgacccccgagtgtgaacactgtgggcaacgacaccaggtagggctaggccaggggaggcaaaggagcaagagggtcttgaaggtcatagtccctgctcacctgtccccggtgcgcccccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45274 - DNA, 2276 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggtgagtggtggtaaggtgggggtggggctcagccagggaaagaaggggtaaagggcagatggggtcccacctactcctcccctcgcacaggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45275 - DNA, 2053 bp, Homo sapiens
cgcccacccactgtgccaacatggcggcgcccaggtcctaattcgggaaacgtgcaccttgactaattcggttttctgtggctacgagagcagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45276 - DNA, 2011 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggaattcaatcgggacctgacgagcaggggtcagacgttagcctggcatcggctagtgggtcagtgtggatggcgggggcggggtatgagctagtcctctgtctcccaccagatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45277 - DNA, 503 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgaccccccctggacctggggctgccgctgggccaggcatagactgaaccaataaagagatgtcacgtcaccttcaaaccgattgc

SEQ ID NO: 45278 - DNA, 531 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccatgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45279 - DNA, 2761 bp, Homo sapiens
  misc_feature (10)..(10): n is a, c, g, or t
  misc_feature (65)..(65): n is a, c, g, or t
  misc_feature (68)..(68): n is a, c, g, or t
catcatgttngccaggctggtctcaaactcctgaccagcctcccaaagtgctgggattacaggcntgngccaccacgcccggcccaggccccagcagttctacagcacctagtatccccacttcctgcccacagagcccttgggggctggaacgtgggtcctcagtacatgccacatggcacaccgataatgctggtcagaataggttggatctatgctttcctcactcgtttagtgcccccagcagtgccacagacagggactgttgtgattttgcagatgaagaaactgaggcacagagaggggatactcacttgttgagggtcccacagccaggactttcaggggtgggcttggatcccagggagctggccctgagcctgtacttgtgagtaccacatagggctcctggtggggtgggtggatagtggaggggaggctgacacccaccccccacccccaggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccaggtcagcccgggggcagagagcggtggtggattgagagaggagacaggaccttgccctgggggatctggggcttcttaagggacagagccagtctaagggaggagttggggtgtcgtggtcacgctgggaactcgtggccactggtaccccccacagcaagcaggcgctggtgttccagtgtgtgggctgcggggccttccaccttcagcgtctcggcaaagcgtcaggagtccccagcggccggtgagcagggaggaaggagaagaaggggagtcccagggttttcctccctccccaccaaccacccctctctgtttagggccaagttctctgcagcctgtggtccccctgtgacccccgagtgtgaacactgtgggcaacgacaccaggtagggctaggccaggggaggcaaaggagcaagagggtcttgaaggtcatagtccctgctcacctgtccccggtgcgcccccagcttggtggccccatgtgggcagagcccatccatgacctggattttgtgggccgtgtcctggaggctgtgagcgctaaccccggccgcttccacacctcggagcggatccgaggggtcctgagcgtcatcactgaggtgagagccgggctgtgacggggaagggggctccacctgtgcccgtccatctccactcatgcccatcctgtcccccatcgcaggagctcccggacgtgcctctgtactacaccctggaccagctgagcagcaccatccactgcaacacaccaagcctcctgcagttgcggtaagagcccctggggtcgggaggagcctgtcccagaccacagggtggcctggggcaagtccagggattctcatgcatagaacttgcgagggggtggggagaacccggtgcactgtctcattcctgtaatcccagtaccttgggaggctgaggcaggaagatcacttgaggccaacctgggcaacgtagtaagaccctatctctaacaaataaataaataaatatatatgtacacacacatacatatacacacacatacatacgtatgtatacacacacacacacacacacacacccattagcctggcatggtgatacatgcctatagtcctaactactcaggaggctgaggtgggaggatcatttgggccaggagtttgatgctaaagtgagctatgatcatgccactccagcctgggtgacaaaatgagaccctgtctctttaaaaaaaaaaaaaaaaaaaaaaaattaggccaggcttattggctcatgcctatattcccagcactttgggaggctgaggtgggcagatcacttgaggtcaggagttcaagaccagcgtggtcaaaatggttaaaccctgtctctactaaaaatacaaaaattagctgggtgtggtggcacatgcctgtagtcccagctacttgggaggctgaggcacgagaatcactggaacctgggaggaggaggaggcggtggtgagccaagattgcgccactgcacatcaacctgggcaacagagcgagactccatttaaaatataataataataattagaaaaagaaaaaggccaggtgtggtggctcatgcctgtaatcccagcactttgggaggctgaggcgggcgaatcacttgaggccaggagttcgagaccagcccggtcaacgtggcgaaaccccatctctactaaaaataccaaaatattagccaggcgtcatggcacatccctgtaatctcagctactcaggaggctgagacaggagaattggttgaacctgagaggcagaggctgcagtgagccaagattgcatcattgcacaccagcctgagcgacagagtgagactccacctcaaaaaaataataaataagaaggccaggcacggtggctcactcctgtaatcccagcactttgggaggctgaggcgggcggatcacaaggttaagagatcgagaccatcctggccaacatggtgaaaccctgtctctactaaaaatacaaaaattagctgggcgtggtggcacatgcctatagtcccagctattcgggaggctgaggcaggagaatcgcttaaacccaggaggcggaggctgtggtgagccaagattgcgccattgcactccagcctgagcgacagagcgagactccatctc

SEQ ID NO: 45280 - DNA, 2342 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccaggtcagcccgggggcagagagcggtggtggattgagagaggagacaggaccttgccctgggggatctggggcttcttaagggacagagccagtctaagggaggagttggggtgtcgtggtcacgctgggaactcgtggccactggtaccccccacagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45281 - DNA, 2418 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccaggtcagcccgggggcagagagcggtggtggattgagagaggagacaggaccttgccctgggggatctggggcttcttaagggacagagccagtctaagggaggagttggggtgtcgtggtcacgctgggaactcgtggccactggtaccccccacagcaagcaggcgctggtgttccagtgtgtgggctgcggggccttccaccttcagcgtctcggcaaagcgtcaggagtccccagcggccggtgagcagggaggaaggagaagaaggggagtcccagggttttcctccctccccaccaaccacccctctctgtttagggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45282 - DNA, 2294 bp, Homo sapiens
  misc_feature (60)..(60): n is a, c, g, or t
  misc_feature (2208)..(2208): n is a, c, g, or t
  misc_feature (2221)..(2221): n is a, c, g, or t
  misc_feature (2223)..(2223): n is a, c, g, or t
  misc_feature (2227)..(2227): n is a, c, g, or t
  misc_feature (2290)..(2290): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccaggtcagcccgggggcagagagcggtggtggattgagagaggagacaggaccttgccctgggggatctggggcttcttaagggacagagccagtctaagggaggagttggggtgtcgtggtcacgctgggaactcgtggccactggtaccccccacagcaagcaggcgctggtgttccagtgtgtgggctgcggggccttccaccttcagcgtctcggcaaagcgtcaggagtccccagcggccggtgagcagggaggaaggagaagaaggggagtcccagggttttcctccctccccaccaaccacccctctctgtttagggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggtgagtggtggtaaggtgggggtggggctcagccagggaaagaaggggtaaagggcagatggggtcccacctactcctcccctcgcacagtttcaattcttcctantaatctatttatnanatantcattcttcttcataacaatcttaaataccctcctaaatattttccccatctttcttcccttntcaa

SEQ ID NO: 45283 - DNA, 2095 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacatgtgctgtgatcaccgagtttgctcgcattcagcttggggccaaaggaatccagatcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45284 - DNA, 2505 bp, Homo sapiens
  misc_feature (60)..(60): n is a, c, g, or t
ccaccccccccacaccaccccaccaacattacggctagtacaggctgcgtgttaatcggncgatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacgagcaggggtcagacgttagcctggcatcggctagtgggtcagtgtggatggcgggggcggggtatgagctagtcctctgtctcccaccagatgtgctgtgatcaccgagtttgctcgcattcagcttggggccaaaggaatccagagtgagtggaggtccaggcttctggtgggcgggggtcacacaagtttatctccctgcctgggctcttctgccgcccaaatccagaggggcttcagccacatagcaggccctgggttctgctccttcagcctttccgcagggatttcagggacgatattttggagattaaggggaggtttctcagaggggaccttgttattctctgacttgtgcctctgggtggctgcagtcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggatgctgatgtaccagcaccagagggtgtcggagaggtttgacgtcatcgatctggacccctatggcagcccagccaccttcctggatgcagctgtgcaggctgtgagtgaaggagggttgctgtgtgtgacctgcacagacatggcggtgttggcggggaacagcggggagacgtgctacagcaagtacggggccatggccctcaagagccgggcctgccacgagatggccctgagaatcgtcctgcacagcctggacctccgcgccaactgctaccagcgcttcgtggtgccgctgctcagcatcagcgctgacttctacgtgcgtgtttttgtccgtgtcttcaccggccaggccaaggtcaaggcctcagccagcaagcaggcgctggtgttccagtgtgtgggctgcggggccttccaccttcagcgtctcggcaaagcgtcaggagtccccagcggccgggccaagttctctgcagcctgtggtccccctgtgacccccgagtgtgaacactgtgggcaacgacaccagcttggtggccccatgtgggcagagcccatccatgacctggattttgtgggccgtgtcctggaggctgtgagcgctaaccccggccgcttccacacctcggagcggatccgaggggtcctgagcgtcatcactgaggagctcccggacgtgcctctgtactacaccctggaccagctgagcagcaccatccactgcaacacaccaagcctcctgcagttgcggtcggccctcctccacgctgacttccgggtctcactctcccacgcctgtaagaacgctgtgaagacggatgcccctgcctctgccctctgggacatcatgcgttgctgggagaaggaatgtccggtgaaacgggagcgactatcagagactagcccagcgttccgcattctcagtgtggagcccaggctgcaggccaacttcaccatccgggaagatgccaaccccagctcccgacagcgaggactcaagcgcttccaggctaacccggaggccaactggggtccccggcctcgtgcccggccagggggcaaggcggccgacgaagctatggaggagagacgcaggctgcttcagaacaagcggaaggagccgccggaagatgtggcccagcgggctgcccggctcaagacatttccttgcaagaggtttaaggagggcacctgtcaacgcggggaccagtgctgctactcccacagccccccgacacccagggtttctgctgatgctgcccctgactgtccagagacctccaaccagaccccccctggacctggggctgccgctgggccaggcatagactgaaccaataaagagatgtcacgtcaccttcaaaccgattgc

SEQ ID NO: 45285 - DNA, 653 bp, Homo sapiens
  misc_feature (649)..(653): n is a, c, g, or t
ctggggcctcaccagatgcagatgctggtgccacgcttcctgtacagcctgcagagccatggctgcacaaacctttcttcctcataaatcacccagcctcgggtgttcctttctagcaacacacacggactgagccggatgacatgaagcagctgttcccgcctcctcctggcacctccctgactcacgcacttggtgcgtggaggggtcgtgagcgggcacaggcagccacttcgctgcttgcctcatcagcctcacagttccccacagctgtcgaggatgccctgatgtctgttctcacatcacattgcgctccaagtaccccggctgcaaccagagctcagcaaaccgggaccagagggcacatccaccctgcctgcccatgtcaacagagttgtgtgggagccagccggcccccaggaagaccccagatcttcctgcccctgaccacagctctgtccctggaagcatatgctgcagacacttgctctgctgcagattttctgcacaacccctcctcatgggggaaggtttggtacctgaatgaggcctcttttgacctctattcctatcactatttttggtgacctcaatatttatgaaggtaataacttggtctttaatccagacaattttcacctccaaaaannnnn

SEQ ID NO: 45286 - DNA, 1016 bp, Homo sapiens
agggatgactcagcactgcccctcaacagggatgactcagcagggatgactcagcactgtcccttagcagcgatgacacagcaaggatgactcagcactgcccctcaccaaggatgactcagcactgccgctcaacagacatgactcagggatggcttagtactgcccctcagcagggatgactcagcagggatgactcagcaccacccctcaacagggatgactcagcagggatgactcagcactgcccctcaacagggatgactgcagggatgactcagcactgcccctcagcagggatgactcagcactgcccctcagcagggatgactcagcagggatgactcagcaccgcccctcaacaggcatgactctgcagagatgactcagcactgcccctcagcagggatggctcagcagggatgactcagcattgcccctcaacagggatgactcagcagactcagcagggatgactcagcactgcccctcaacagacatgactcagcagggatgactcagcaccgcccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgt

SEQ ID NO: 45287 - DNA, 935 bp, Homo sapiens
agggatgactcagcactgcccctcaacagggatgactcagcagggatgactcagcactgtcccttagcagcgatgacacagcaaggatgactcagcactgcccctcaccaaggatgactcagcactgccgctcaacagacatgactcagggatggcttagtactgcccctcagcagggatgactcagcagggatgactcagcaccacccctcaacagggatgactcagcagggatgactcagcactgcccctcaacagggatgactgcagggatgactcagcactgcccctcagcagggaatgactcagcactgcccctcagcagggatggctcagcagggatgactcagcattgcccctcaacagggatgactcagcagactcagcagggatgactcagcactgcccctcaacagacatgactcagcagggatgactcagcaccgcccctcagcaaggatgactcagcagggatgattcagcagagataactcggggatgactctgattgtccttcagcagggatgagtctgttttgctccgatggaagcatctgtagtgtccatcagcaggtgaatggccaaagtggtatatactgtagtcacattcagctataaaaaggaataaagtatcgatgcatgccacaacatgggtgaacctagaaaatactgatctaaatgcaagaagccaggcacaaaaggccacatagtatatgttcccatttatgtgaaatgtgcagaataataataaaaatgtatagaatagcaaatctgtagggacagacatgaggtgagtggttgccagaagtggaaatgggagttaactataaattgcacagggtaccttacagagatgatggaaatgtcctaaaactagattatggcaatagttgcactacgtgatcagtttattaaaaatcgttgatgtgtgtgtgt

SEQ ID NO: 45288 - DNA, 608 bp, Homo sapiens
agggatgactcagcactgcccctcaacagggatgactcagcagggatgactcagcactgtcccttagcagcgatgacacagcaaggatgactcagcactgcccctcaccaaggatgactcagcactgccgctcaacagacatgactcagggatggcttagtactgcccctcagcagggatgactcagcagggatgactcagcaccacccctcaacagggatgactcagcagggatgactcagcactgcccctcaacagggatgactgcagggtttcatgaaggctttgatgaggtttgatgacagggtttgtcatcgaaaccctacggcatgtcaggtaacaaaagccagtctgcccagccttccatctttacctttggaaatcgagacctgaatgggtcccattctttttctgtaatccaacagaaaatgaaaaaaaaacaaaaaccaccgaaactttttccccctatttgggattctaagaggacacatgagtcacataagtgcatttaactcagacaactttagatcctaatgaaatactagacaagagagaaaatggcatgagtggacagttctccctcagggtttgatgacgggatcctcagg

SEQ ID NO: 45289 - DNA, 399 bp, Homo sapiens
agggatgactcagcactgcccctcaacagggatgactcagcagggatgactcagcactgtcccttagcagcgatgacacagcaaggatgactcagcactgcccctcaccaaggatgactcagcactgccgctcaacagacatgactcagggatggcttagtactgcccctcagcagggatgactcagcagggatgactcagcaccacccctcaacagggatgactcagcagggatgactcagcactgcccctcaacagggatgactgcagggatgactcagcactgcccctcagcagggatgactcagcactgcccctcagcagggatgactcagggcaggtcccagtcaccaccgttgctatcacgacggcccaagttccaaacatacaagcctgcac

SEQ ID NO: 45290 - DNA, 292 bp, Homo sapiens
catgacatacttgtatcactggtttatgtgaagctctcatcaaaaaattattttaaataatgcaataaaatcctgggatgtcactgccttagaggacacttaaccgtggacagtgacttgtcccatctccatggtccaccccaatcccatgctgctggcttctgcccaggcacctgccgtcttgaatttggtgcctctcattcctatgccttcctgtcatctatttgtactccttcaaagtatatatgttttgtttcatttgtcttaattttattaaaagagtatcttgtac

SEQ ID NO: 45291 - DNA, 546 bp, Homo sapiens
gtcattctaattcaaagagagttctcaacctttggggggttagcttaactttataatcccctgcaaaacctttcttaaagttttgtaacatgcacttcaatggagtaagttttgatggactttccttctattccttcctttacggcccagcacactcactcttcctctagtttcggccaactataccatctcctattacgggagttttcagaagctacttggctttggagagttccttattcctgctacaactctgagctgtagggcagctcctattagccatacgcagatcaccactagtcttagttggccccacactttgctcggagcacccagtccacactaagaggaattgtggacttcccattttgtggctgatcagcctaataaggcttcttcatttacacactgttacacacttccccactcccagttcctaagttcctaattagggtggtaagccactctcgccacctccagtttccttttcctaatcgacttagcaaaccattctcacatcctgtgatggttggggtgtgagtttca

SEQ ID NO: 45292 - DNA, 935 bp, Homo sapiens
ttttttttttgaatctaggagccaatgctttaagttaccctgtcttcttactttcctttaacatgataaaaatagattaatctgccatgaaaaagtgaaaataccaaaccttggtgtgtgatgggaaatgaactcatgaaacactactggacttatgtatcagcacaacaccttagtatagatttatctgcgcctgtgtcctgggccatattttataatttgattaatattgtcctttgggaatccctgattcaataggattagtatccttatgaaaagagactcaacagagcttgctctcattctccctctgccatgtaaggacacagtgagaggacagctgtctacaagccaagagaagaaacctgaatgaaacctatcttggtggtacttgatcttagactttccaatctccagaactgtgagaaataagtttcttttgtttgtttaatctaacccagactatggtattttattaggcagcccaaacagactaagaccagtcatttgtgtggatgattgatgtggcatgtggttgatgttttaggaaagggtgatattcaaggacgtggctgttgtcctcaccaaggaagagctggcactattggataaagcccagataaacctgtaccaagatgtgatgttggaaaacttcaggaacctcatgtcagtgagtgagtaactgagcatcagaccactggacctgtttcctcaaatcatcatttcaagccagatagaatattccagttagaccacaaagagaaactttgaccactggagagaaaaatcctaagagctgcatgcacaagttaggaccctgcagttaatgagcttttacagatcattgtgaggatgtggctccttgtgatgggtttgtgagggagctctccccaaatcttccacccctggcctgtgggcattcattgcaggaggta

SEQ ID NO: 45293 - DNA, 341 bp, Homo sapiens
tttgataatatggagaggggactgaaggaaagaaaaccaagttttgactgaatgtatttccttaaataaaaacgtatttaagtgttcagagaaaataactgcctgttgtttatcctaagaaattattcttcaaaagtgaagaggaaataaacactttctcaacaaaaattgagggactctactgcaagtacacctgccttgaaagcaatgttagcagaacttcttaacaaagaagaaaaattatgtaagtcagaaacttgtatctacataaagaaaaaaacagcattagaggctaggcaggatggctcatgcctgtaatcccagcattttgggaggccgag

SEQ ID NO: 45294 - DNA, 2381 bp, Homo sapiens
tattgaaatattaaatgcattgtagaatttgatttaaaatttagaacaagctgtcaggtatgataactagtctcatttaacaaatgaggattccagggcttgaagaagttaagtagcttcctctagattgtaaagagagtctaacctggccctttttggttttaagggcatgatgataaccacttgctctactgatttctaatggaaagtgcttcagttttccactttgcctagctagtgattatttaatatctgcttatctctgaatttatctgcatatttctaaaactttatgacattaaggaaagttggggaaaattcactttaagtgttgtaatgacaatagctatcaatcattgagtactgtgtactaagcattttatattttatcaacaagtacttacatgtgggataagtactgttattattttcattttatagatgaggacacatatagaatgcagttaggaaactagagaaagagaaaacatggagaattatctggaactaataagacagtaaagtacagatttaagaagttcagtgaatcccaagcagtgtaaattaaaaaactacattgagatacatcatagtgaatatgcaaaacatcaataataaaaagaaaaaccttaaaggcagctttaacagtatactgaatgaccaatatactcagcagccacagaacctctattcttttaaagcatccatgggactttatagaaattgactatgcactggactataagcatatgcaataaaatttcaaatgactgaaaccatatgagtatattcttttgccacaacacaattaggctagaaatgaacaacaaaaagataacaggaaaatctctatatatcagaaattaagagatgcacttatttattttttgttttttgtgatggagtctcactctatcacccgtgcagtggcacgatcttggctcactgcaacctctgcctcttgggttcaagtgattctcctgtatcagcctcccaaggagctaggattacaggcgtgtgccaccatacccagctaatttttgtatttttattagagatgggatttcaccatgttggccatgctggtctcaaactcctgacctcaaatgatctgccagcctcagcctcccaaaatgctgggattacagatgaagagatacacttctaagtaatctatatgtcaagtaagacaaaatgaaattagaaaatatttttaagtcaatgatattaaaccatactacacatcaaaacttgtgggatgcacttaaagcagcatgtagagggagattatattcataaatgcttatggtagaaaagaaggaagtctgtacattatgtagctatgcacccatctaaagaagttaggaaaatgacatcaagtagaacatcaaaagaaagaaggaaaggataacttaaaacagaaatgaatgaaataaaaccagaatagaagagacgatctacaaatccaaaagttggtttgttgaaaatactagtagagctgacatacttgtggtgagactgatggaaataatgcagttacaactaaccaatatcataattggaaaggaaatcactataggtgctgtaaaaattaaaaagataatagaatattatgaacaattttctgccaatattattgaaagtttagataaaatggaaaattcatttaaaaatataatttgacagtattatgttatgtgaatactataatgataatcctgtaatcattaaatgaaccagtagtttaaaatttttccatatagggaaggtcagggccagatgtgttcaatggttggttctactagacattcaaaaaaataataattcaagtctacacaaactttcctgagattagaaaaaataaagaagagtccccccacctgtttcttactttatgagaccacacctaaaagatagaagactgctttgcaaccaagaaatccttcatgaacacctctttaatcacaagtcctcaactccaaggttagctttatttcaacttttataatacttttcttacttttcttgatagctttaccacccatgtattcattcctaaaaaatacacagttttgtctgattttgaattttatgtgaatggaattgtacatatctgtgtttgtgtcttccttgttttactcaatactgtttctgagatcaatcacattatttgttaatattttgtttaggatttttgcatctctatttcagtgtgtgtttggaatgtaaatttccattctcagactatcttttggcctgaatttggttacatgagtatatgttctaaaaatattacttacactttcaataaattttaaggacttttatattgttatgtatcaaattttttagaatgcaagaataaatattataaaacatcc

SEQ ID NO: 45295 - DNA, 854 bp, Homo sapiens
actctagacgatccccttcgcaatatcataattggaaaggaaatcactataggtgctgtaaaaattaaaaagataatagaatattatgaacaattttctgccaatattattgaaagtttagataaaatggaaaattcatttaaaaatataatttgacagtattatgttatgtgaatactataatgataatcctgtaatcattaaatgaaccagtagtttaaaatttttccatatagggaaggtcagggccagatgtgttcaatggttggttctactagacattcaaaaaaataataattcaagtctacacaaactttcctgagattagaaaaaataaagaagagtccccccacctgtttcttactttatgagaccacacctaaaagatagaagactgctttgcaaccaagaaatccttcatgaacacctctttaatcacaagtcctcaactccaaggttagctttatttcaacttttataatacttttcttacttttcttgatagctttaccacccatgtattcattcctaaaaaatacacagttttgtctgattttgaattttatgtgaatggaattgtacatatctgtgtttgtgtcttccttgttttactcaatactgtttctgagatcaatcacattatttgttaatattttgtttaggatttttgcatctctatttcagtgtgtgtttggaatgtaaatttccattctcagactatcttttggcctgaatttggttacatgagtatatgttctaaaaatattacttacactttcaataaattttaaggacttttatattgttatgtatcaaattttttagaatgcaagaataaatattataaaacatcc

SEQ ID NO: 45296 - DNA, 369 bp, Homo sapiens
cgcaccactgcactgaagcctgggcaacagggtgagactctgtctcaaaaaaagaaagaaagaaaattaaagtacagtggcaagggcaaaggtgtcactagtcaatgtcaggagggcagtgcccagtggtggtggtggtaatggtggcttccccaccggggtgtggctgcatctgatattaggaacattcttgctgctgtctattcttggcctcctgccacattcctgagccggattccgtagcctttccatgtatcctttgctttttttttagacagagtcttgctctgtcacccaggccagaggttgcagtgagctgagatcatgccattgcattgcagcctggacaaagaatgaaactcagtctca

SEQ ID NO: 45297 - DNA, 361 bp, Homo sapiens
tcactctgaaacggattcgaggcagcagcaactgaaccttttgctgttctacctaaaggtgtgcagccagctggccatctccatgctgggagaggcaagacgggagttttttgcccagacctagccctcagccctgtccaagtggaggtgcttcccttagcaaatagcgaggagctggtgatagggatgtcaccaggccacttctccaagtgaagtggattcctcttatccagggccccttgctgaactgcaggctgcagagccttcatcacctagcaccacatgtggcttggagagagcttctgatacacgtcatggacagccacctgacattaggtcggcattccctgcaagtgccact

SEQ ID NO: 45298 - DNA, 1268 bp, Homo sapiens
tgaacatgacttctggagtcaaggttgttgggccattccccccgttccactcactgggaatataaatagcacccacagcgcagaacacagagccagagagctggaagtgagagcagatccctaaccatgagcaccagccaaccaggggcctgcccatgccagggagctgcaagccgccccgccattctctacgcacttctgagctccagcctcaaggctgtcccccgaccccgtagccgctgcctatgtaggcagcaccggcccgtccagctatgtgcacctcatcgcacctgccgggaggccttgggatgttctggccaagacagtggccttcctcaggaacctgccatccttctggcagctgcctccccaggaccagcggcggctgctgcagggttgctggggccccctcttcctgcttgggttggcccaagatgctgtgacctttgaggtggctgaggccccggtgcccagcatactcaagaagattctgctggaggagcccagcagcagtggaggcagtggccaactgccagacagaccccagccctccctggctgcggtgcagtggcttcaatgctgtctggagtccttctggagcctggagcttagccccaaggaatatgcctgcctgaaagggaccatcctcttcaaccccgatgtgccaggcctccaagccgcctcccacattgggcacctgcagcaggaggctcactgggtgctgtgtgaagtcctggaaccctggtgcccagcagcccaaggccgcctgacccgtgtcctcctcacggcctccaccctcaagtccattccgaccagcctgcttggggacctcttctttcgccctatcattggagatgttgacatcgctggccttcttggggacatgcttttgctcaggtgacctgttccagcccaggcagagatcaggtgggcagaggctggcagtgctgattcagcctggccatccccagaggtgacccaatgctcctggagggggcaagcctgtatagacagcacttggctccttaggaacagctcttcactcagccacaccccacattggacttccttggtttggacacagtgctccagctgcctgggaggcttttggtggtccccacagcctctgggccaagactcctgtcccttcttgggatgagaatgaaagcttaggctgcttattggaccagaagtcctatcgactttatacagaactgaattaagttattgatttttgtaataaaaggtatgaaacacttggagcctga

SEQ ID NO: 45299 - DNA, 710 bp, Homo sapiens
cacgatgaaacagcacaattttcaggagtccacaattccagcgaggcgcgtggatgggaaattgtcacgttgtgaattgtgtttgtgctttgctaaatcgccacccggagctgactgtcaaatcctatttgctttgctaaataaggatatctcatcaaattagcctttaatgatacttctacaaatagggtgttttacatgaattaacgaggccggaacactgactgtttctccaagatactgagctataatggaggcgacgaagccgaatgttaaaattactgaattgttaagtgtgcaaaatcagacagaatttagtgctaaatgtgaaacaatttctgcttttaatggtgagcattcgcaacagcacaagcattacttatattcagccgtctgaaactgtgcatgtaattatgaatacatttaacaaactttaacccccctctgagtctggaaacagtctagtatggtgaagagattataaatcagcattttgcagtgagaagtcatcattaattcagcaaagaatcacagcttcttttcagatccttcccaccaccctcctacacacccccctcaaccaataaggaaaaaaaaattcagcatggaactgctggatacactgaatatattttggcttttctctttttgcctctgtgtgagaaacttcattaagcagttgctgttctctccccacccccgctaacccc

SEQ ID NO: 45300 - DNA, 336 bp, Homo sapiens
gctgcttggtaaccaagctaggaaatggcatagtcaagatccgaagtctgaccctgaagcccatgctctctcctcaatgtctccaggtttagaaaactcagaaccgagaccaataaggtaaagcactgctttaagtatttttaagtatttttaaaacactatacactaggctcttcctccctgaagagcagcgctgtgcggccagaggacagggctagtgtaagtcctgcaaaatccttagcccaggccctcactcctgttccacagacctcgtccctttacagcctgaggatctgggccaatccacaccacacacttagacaggagagtcccagc

SEQ ID NO: 45301 - DNA, 827 bp, Homo sapiens
ggcctgtggagctgctgtctagacgcagatcatgggtggcgggtatgatctcaacctcttcgccagccctcctgacagcaacttcgtgtgctccgtctgccatggggttctcaagaggccagcaaggttgccatgcagccacatcttctgcaaaaagtgcatcctccggtggctagccagacaaaagacctgtccgtgctgtaggaaagaggtgaaaaggaaaaaggttgtccacatgaataaactccggaaaaccattggccgcctggaagtcaagtgcaagaacgccgacgctggctgcatagtgacatgccccctggcccatcgcaaggggcaccaggactcatgcccctttgagctaacggcctgccccaacgagggctgcacctcgcaggtgccgcgtgggaccctggcagagcaccggcagcattgccagcaagggtcccagcagcgctgccccctgggctgcggggccaccctggacccggccgagcgtgctcgccacaactgctaccgggagctgcacaacgcctggagcgtgcgccaggagcgccgtcggcccctgctgctgtccctcctgcggcgtgtgcgctggctggaccaagccaccagtgtcgttcgtagagagctggcggagctcagcaacttcctggaggaagacaccgctctgctggagggtgccccacaggaggaggccgaggctgccccagaaggcaacgttggggctgaggtggtgggggagcccagggccaacataccttgtaaataggtaaataaaagcagacccccggcctgcctgcctctgtgcctgcggccctcaaaaaaaa

SEQ ID NO: 45302 - DNA, 975 bp, Homo sapiens
tgggaggcatgtttgcctgatgtagttccaggcttgacttttcccttggcttagtgatttggggctcctggggtttattttcctttcacagtgatatctattttttttttttttggttgttttttgttttgttttgtttatgaggtcagtctcgctatattgcccaggctggtcttgaattcctgggctcaagcaatcctcccgtcttggcctcctgaatagctgggactataggcatgcaccaccgtgttcggcttctttagtgatatcttctgagcacacaaagcaccagctaacattaacatgctcatgattttggcaaccccgcctaggggtaaagtgtgatgaagcatttataagttaaatcacctctgtcataaattggtctcacagaatagtcctttctttttttacagtccattttttccccacttatttctattcttaatttcaaaaatatttaattttctaattatatttctcacacattcaagaaaataacttggaatctagaaataaaatgcaccagcatctgtgatatcattaagcagtgagcacatcttgtaaaaacagagaaagttacactcccaaggtctatgagcaggtgcaatacaccttggctgctgaaacccacatctgcagagtcatcggaagctggactgtgagtgcttgaagtacaagtgtatgtgactaaaaccaaaggttttactttacaatattctaaaaagtcaaaagtgtgatgaaatacacaaccaaataggtagtttaaaaagaaaaaattaaatgatcattatctataagcaatgatttttggtttaaaaacctcagttgagtcaactgaaaaacattagaaataatgagtccagaaacatagctaatcataagataaatatgccaaagacccatggctttcttggaaacccacaaaaatatatttagaaagtatgagaaaaaaatccctattctcaaaagcaa

SEQ ID NO: 45303 - DNA, 776 bp, Homo sapiens
tgggaggcatgtttgcctgatgtagttccaggcttgacttttcccttggcttagtgatttggggctcctggggtttattttcctttcacagtgatatctattttttttttttttggttgttttttgttttgttttgtttatgaggtcagtctcgctatattgcccaggctggtcttgaattcctgggctcaagcaatcctcccgtcttggcctcctgaatagctgggactataggcatgcaccaccgtgttcggcttctttagtgatatcttctgagcacacaaagcaccagctaacattaacatgctcatgattttggcaaccccgcctaggggtaaagtgattagggcagatgatactattagatgcaaggatctttgacccagcagccaggcaaaagtcattggcgtggtatgccacaggacagcggacacagcgcatcaaccgacctttagatgcagaaacattggctggattagcagcatgacaggttatacagatgtggagggagcaccggaagcccttgttctgcataacagtgggtgggtacttctggacacactcttcatggtaaaactttccacacaagggtagaaggcaccttttaacatcttcccactctgcttacatacaaaacaggtatggattcctgtgcgacattcattgcagataaattttcctcttggcatctcagtcaatccaaggcactccaggtggaaagccccacagcactgagcctcacataacagcagatcacccaatttcgtcaattctag

SEQ ID NO: 45304 - DNA, 403 bp, Homo sapiens
tgaagtgctaagcactttgctagcctcttcccaggatttagaatgagattgtcctaattcttaagtggttcactatctcataagggagacagacaaatcttggtaccgtaaggcagcgttgaagtgctggaatagggcatgggcagagtccttcatgtttacggatgatagaaccactgatcctctctgagatagtgggaaggcgtcacagcatagatggcattaaagtgatccttagagaatatggggcaagtgtagtgggagttaagttgaaaagggtccagaacgttgttgtgaaacttgtacgctaagtgtttgattggagctgtgctttggaactgcgtgtgcctcaaatagtaactttcatagccttcttgccgatacttggagcttcttttcagcc

SEQ ID NO: 45305 - DNA, 557 bp, Homo sapiens
tcatattcactgataacatttactactgttattgactgctttaaaagtgttgggcattgtgctagaaaccattatatgcattatctccttgaattctcacaaccgcctactgaggtattctcagactctaagaaatgagatttaagagaagttatctgcccaaggtcactcggctggaacctgggctgtaaaaatggctgaagcaggtgatgaggagctgatgcgtttggacgtgtctcagagaaatcatggaggcgctgcggttcctaccggttcttggatgccttctacagagacaaccatagccccaaattatagggatcacatatcagtgggtgagacatccttgcttgggatgaggaggggatgagctgtgtgaagcaaggcgcctctgtgatgggttccagtgatgtgtctgccactgtcttaataactgtgcaattctaagcagaacctttcctgtctctgggcctgagagttcccctctgaaagatgaggacttgacctagcaaggtcctactcacatgcctgtagagaacaggcaggggaagttagaa

SEQ ID NO: 45306 - DNA, 208 bp, Homo sapiens
tgagactccatctcaaaaaaaaaagaaaacaaaaatagatgcaaattaatccaaacattaatttcaattattagataaattaaacaagattaaaacaaatatttaccagcctttgtttttaaatcttaataatgttcttctggttgtaggtggttacaggctcaataagaagagagcctagtactaaactagagcctgactgaataag

SEQ ID NO: 45307 - DNA, 407 bp, Homo sapiens
ttttcagcaaccccagggcgtccatctccaggatgagtggtcctgactgaaaattgtgaggggatatggtgaaggtttagaagtcacatccgtgccactaaacaggtctatgtgatgatcttcctgctctgcattcttatctgttcttcaaatttttcctaagcataggaaaaaatgaaactaagtagctgtcttctaattattaagatctttaaaaaattttccatatcatggataagtaataagtcaatcaataaacatttattaaacacttgatatgtacaaggcactgctaggagctcgggtgaattccccaaatcataatattttggctgtaggaaagataataataaagaaaagtgataatccaccaccaaatagaccatatcactaagaaatgggttcct

SEQ ID NO: 45308 - DNA, 518 bp, Homo sapiens
tattccatagtgatccaataagatgacaacaccgggccaggcgcggtggctcatgcctgtaatcccagcactttgggaggccaacacaggtggatcacctgagctcagtagatcaagaccaccctggccaacatggtgacaccccatctctactaaaaatacaaaaaattaaccaggcatggtgggccacgcctgcagtcccagctacttgggaggctgaggcacaggaatcacttgagcccgggaggcagaggttgcagagatcacgcccctgaagagagtgagactccattgcaaaaaaaagaaaaactgcaatactgtatttttactctaccttttcccttttctatgtttacatacacaaatatcattttgttacaactgcctgtagtattccatacagtaacatgctgtataggtctgtagcctaggaacaacaggctataccatctagccttggtgtatagtaggctataccatctaggttggcaaatacactcttatgatgctcagacaac

SEQ ID NO: 45309 - DNA, 398 bp, Homo sapiens
cctcctccctcctgaaaggcaccattgtcaccaaaacaagtcccctttgtcctccaccgcagctggagcctgggccttccatctcctgggggccaataaaaccccagatcagccaatcctccctccctggctctgtcaagtagcaggcacgttcctggtgacggggagtctgttgagatgttctcaaatgcagggtgatgcccctttgagataaaagggacaactcagccagtgtcaggcctgcagaggttgcttattgggcagatgggacttgctgctgctgctcagcccctaaacaaggactgcagactcaattgccttacaggggccaggccaagggcaggaagaggggaagcaaggtggatatgaagcagtagggagtggtggggaccctggag

SEQ ID NO: 45310 - DNA, 538 bp, Homo sapiens
attcaagcagtgccatctagaccttttctcttctcatttcttcaaaagcagtgctaagtaaaataataataataaaaatggtttatgaaccaaaagactttacattctagcattaggaacacacacaaaaaaatctgtcagcttacaaaagcacaacacataaagaaagagcagtggaatgcgtaatggggaaatgaatcatgtttaaagcaagacttgcattaaattggcaactaagataatttccattttctataggtaaccgtgttccagtttaatgattaccttcatactcaacaagaaaaatggcaaagcaacatcatcaaaataggtcttacaacatatctacatgtatatatgtgtatatatagattcatataaacatacatacatatatatgcattcatatgttggaaaacaaaaggaataagctaatatgttttatttccttcattaaaccagtatatgagtatttttaatttggcaaacaaaaatcaacatactgaaataagtaatacagggtactgagcatttctct

SEQ ID NO: 45311 - DNA, 1393 bp, Homo sapiens
  misc_feature (991)..(991): n is a, c, g, or t
  misc_feature (1005)..(1005): n is a, c, g, or t
gttcttgagagctgtcatgttgcagcaacttggctacactcatcccacacccccaaactccacccttgctctggctctgtccttgtcatctaaagagcttttagaaaatacagatgcctgcacacccctccaccaccccgcaaatcccagtgtcatggtctgcggtattaagtgctgtcgtggaactgggctgctgtcctactgcagtactgtcttcctgatggcaaggataccgcttattcaactttgctcccccatcccactgaatagagtcggacacatggtaggtccccagtaaatggtttgttagatagctttattgtgagtttatttccaaaggtaagaaatcactgggaatttcacaaactggagtcattttacttatactaccttttcataaaatgtatagaaatatcttttcataaaataatttttttagaaatatctttttataaattaatttttttaggttattagcatcagtcttcctgttgtgaagatttctttttaattacatgattgtgtgtgagttacatctcatagaattcctgagagagcccaatcttaggttgctgtaacatgacagctctcaaaaacccgtcgcacagggagaaggacattcattctagaggccagtggccccagcttggaattccacccctgctgctgaatggcagttggatgttgggcaatttacttaacctctcagaacatcattttacttagctgtgaaaatcaataattcagcaacagtgagtgcctattaaggacttgcttggtggttatcagtttattctttctcttatctgaggctcacagttctatgaggaagtaatataattgtcaccataaccactatccatggtttacacatttggaaatctgagatgaaagactttccagattttaagtgtaaagaaattccagagccctcactcatccccaccaagctctactttcctctcaaaggagaaagcagcagggacttttnctgagctgttgggnagtatgagctgaacatctcccaagggtccctcatttccccccttatcccttatggtgccctgaattagcctaatctcctaatttcctcagttacaaagaactgcccaagctccccagttaacttctatctcgggagtggacatgagagccctaatatttgagaccaagctctgtttgctgcctcagtaaaaaccattttctgtagggtttggtgtggactagctttcaaccaaatcatgtcccctaaaacatgcaaaagtgagacccagtgtggtggctcacacctgtaatcccagcactttgggaggctgagtcaggcgaatcacgaggtcaggagatcgagaccatcctgtccaacatggtgaaagcccatctctactaaaaatac

SEQ ID NO: 45312 - DNA, 776 bp, Homo sapiens
aagcttgattgccccctttaaaaaaaaagtggtaaaaaaacccatgacagagtgagaccctgtctcaaaaaaatgaaagaaagaaagagagaaagagaaggagggagggaggaaggaagggaggaaaagaaagaaattagaatctcatagaaatgaaatacaaagatgattaaatgtaattaatgaattaatgcctctgaattagaacatggatttctagaaagaaagaaatgaagagagaagaaaacatcagtgaaataatttttaaaattttctgaggataaaaggaactgggtttctagactgaaaggaaactgagttcccagtaaaatggagaaaagaaacataccaaggttatcattgtgaaattttataactgctaacaaagagatcttacaagctcccggagaggagagaggatatcatatacaaaggaattaaaatagctttgaacttcctaacagcaatactggcaactataaacaatgactttaacattcttatttctatctaatcaaactatcaatcaaatatgagagtagaatgagaactttttagacatttgttttccatgcatctattttgagaaagcttactagacaaggatgcccactttcactgctgttacccagcatagtactggaagtcctagctagagcagtcaaacaagagaaggaaataaagggcatctaaattggaaaggaagaagtcaaattatctgtgtttgcagatgaaataatcttgtatttggaaaaaactaaagactccatgaaaaa

SEQ ID NO: 45313 - DNA, 525 bp, Homo sapiens
  misc_feature (522)..(522): n is a, c, g, or t
cttgatcccgggaggcggaggttgcagtgagccgagatcaagccactgactccagcctgggcaacaaagcaagactctgtctcaaagaaagaaggaaagaaagagagaggagagggagagagaaagaggaaggaaaggaaggaaggaaggaaggaaggaagcaagcatcccatcactgagacttaataattatcaacccatggttttttgaatttcacgcacatcctcactcacttccccaccccacttcacatcaagctttggtaaatctcagacatcacagtgtttttttctttgtttgtttgtattttgagatggagtctcactctgtcatgcgggagtgtagtggctcagtctcggctcactgcaagcttcgcctcccaggagaatcacttgatcccgggaggcggaggttgcagtgagccgagatcaagccactgcactccagcctgggcaacaaagcaagctctgtctcaaagaaagaaggaaagaaagagagaggagagggagagagaaagaggntgg

SEQ ID NO: 45314 - DNA, 328 bp, Homo sapiens
ctaattagtatttaaatgctggctcatagtaacccctatgacaaaacaaaacactgatcaaaatttcagtatttctctagttttttatctcaataagatagtcttaaatgttggaccgagttcatgtaagttaattttctttgatacatttgaaaatatcttgagaaatttaatgcttttgatgtttcatagttaaaatggtctattaaataaacttgcaattttgaagatgcacattttaaatatagcaatgcaatcaatgattactgccatcagtttgggtttggataaaaagatcaatgactcagcaagaatgcccatctgagca

SEQ ID NO: 45315 - DNA, 283 bp, Homo sapiens
caaatttgcatttgcaaaaataactcctacaagactttcagaagtctaggaaaattgtggcttttggattattacattaccaaatttgtggagtttaataggtttcaactgtcaatgtgcattaaaatttcctgggagcagggggatgggcttttaaattctgatgtccaggtgtgtgctccaggcctactaaatctctggggttgggactcttcgttgttttttaagttgccataattccaatttttggcccaaattgtgaactactcaccaaaggcaaaac

SEQ ID NO: 45316 - DNA, 709 bp, Homo sapiens
gagcaaatgtttctctccctctcttgggaggtgagaaggaaaccacggtctctctcctatataagctcccagattcataattttggtgttgctcatctgtattacaaatctcaatatgtgtaggatgacatctggctcttctcctgctgcctgggtggaggagaattggattagaagggggaaccaatatggttgttcccatgagtaagttaattcatctgtctttgctctgggaaatcttatgtttactcttaggaaaacaggaataaatgtaggtattaaaagcttaagagtcagtttaaaaagtgttttagccattctgattcctgtactgtgttatctttattgtggttttattttacattttccgaatgtctaatggtcctaagcatcttttcatgtacttattgaccatttgtatatctttctttaaaacatgctcgagtcttctgacaatttttatgatttttacattgggctgtcttttgttgagttgttagtgttatttattgtattctggatagagttctttatgtatacgtgttgtgagtattttctcctgttgcgtggcttgcctttcttgttttcttaaacagtgttttttgaagagtaaaagttctggattttagtaaaatgcaatttatcagttgtttcttttatggttcatgcctttgtacttttttcaggaaaccattgcctacctcaagat

SEQ ID NO: 45317 - DNA, 384 bp, Homo sapiens
taagtctttctgaggctaaaataacttactgtgaaaataatcgccttctttaccaggctctggtaaagattaaataagaacatatatatgaaaaggtctagcactcttagtactcaatacatgttaagatttattaatctcactaaattagtttaaagggagtgatcttagaaatactatgttatactagtaaacggataacggaaaggatagaatatgagtgagctgggaagtgcatttggaaatggaaatagtgatgatggtcctttaagagcaaatcatcatcttcaaacaataatggtaattaagtattacaataagccaatgatgctggtactatcattattcgtactttgcaagtggtaaaaggctaacttggctaag

SEQ ID NO: 45318 - DNA, 402 bp, Homo sapiens
agtttaattttagatgactcactggacagccctgcagagacacagagaagaatgccttttaggctagcagaatccatataacaacacaagaaacaacaaaccagatgacagctgctgaagcagccctgtcaggcagtatcatgtctcaatacgaaaacagaacgttacatagaaatcagaatttcaattacataaatttcttcctagcagggtattagaataacattatttattcagcaggtaactaatcaggctaaactgaaaacatgccccctaaataattaaataaacaaaatctaccaccactgtgagacagaaagtactttcaaaaatctacaagatctacacaggacagtgatgattactccatcgggcatccaggttagtagccctaaagaaaat

SEQ ID NO: 45319 - DNA, 616 bp, Homo sapiens
gatcgacgctatacaaaaagaaacacttgcgaaggtcacaggccagagacataggtccactaaaagatggagatttaattggaagattatagaatactccctatccccaatgtcttatcactacaccatcagggctctagtataatagtaaattacaatggaaagagctgcaaaaaccagagtgtttctgtttgggaagcccaaagtcaagaggggagacaaaaacaggaacactgagaaatttgatgcctctagcacctatagcaatagcaaacattaatcaaatcacaactcctagccagattaacatagctccttacactagaggcttatttaccttatttacctcagttcctatatacctgatatagcatgtctagtttttaacaaaaaattacaagacagcaaaagcaaggggaaaaaaagttctgaagaaacaaagcaagcttcagaaccagactcagatatgatacagtttttgaaattgtaagacaaggaatttaaaataactatgatcagaatgggtgtggtggctcatgcctgtaattctagcactttggaaggccaaggtaggaggattgttgaggccaggagttcaagaccagtctgggcaaca

SEQ ID NO: 45320 - DNA, 423 bp, Homo sapiens
gttatgtcacaaaagtgttttctttaccagttcgatctttggatcaaagcaagatggagtgtgaatcttcttcagcaagctccagacacacgcccgctccccccagtgtctgtgtgccccagtttgggagtcaaaagttgagtctgggctttggaactgatcaggtgtggcatcctggctctagagctcattagctgagtgaccgccctgaccctcgatttcttcatctgtaaaataggaccaacggtcatcacctcagggtggcctagggatatgaacccaacgggagggggttcaagggtgatgtgtcccccaaggtgagtccttggaggagagattccctggtggtcatgctttgcactgtgagctttgtggagcttacctagaggggcacatgtgggggcctcaactgggctccatagg

SEQ ID NO: 45321 - DNA, 267 bp, Homo sapiens
ccacctgggccctgcctggccagcatctcagctcggccacttagaacctgtgggaccttggtgagttacttcacctcactctgccccagtttcctcatctgtaaaatggtaacattgtaactgtgtctacgttatgtggttggtggtggctcaagcctggcatataggtgattgtcagtaaatactgtggcataaatgaaggaatgagactctaccttctcaaaatattcttagatgttaacttcaattaatggaaagtttattccc

SEQ ID NO: 45322 - DNA, 440 bp, Homo sapiens
ttttttagtttattatttatttttagagacagagtcttggtctgtcactcaggctggagtatagtgatgtaatcatagctcactaatagcctcaacttcctgggcttaagccatcctcccccctcaccctttcatgtaggtaggctacaggcatgccgccattcatagctagtttttttatttttagtagagagagagtctcactatgttgccgaggttggtcttgaactcttggcctcaagcagtcctcccccattagcctcccaaagtactgggattacagatatgaactaccgtgctccctgataccctaaatatttatcaaaatttttcactgctattttcctcataggattaaaagggctatttattattttttataactacagctgacccttgaacaacataggggttaaaggtgcagatcccccgtgcagtaa

SEQ ID NO: 45323 - DNA, 455 bp, Homo sapiens
  misc_feature (119)..(120): n is a, c, g, or t
tattctcttataatacaatattaattataatatttatacataaactaagataataacttaacataaaagatcaaaataaaataaacaatcaaactaaaaatcaaaataaccatcagaannatcaaccatcctcccccctcaccctttcatgtaggtaggctacaggcatgccgccattcatagctagtttttttatttttagtagagagagagtctcactatgttgccgaggttggtcttgaactcttggcctcaagcagtcctcccccattagcctcccaaagtactgggattacagatatgaactaccgtgctccctgataccctaaatatttatcaaaatttttcactgctattttcctcataggattaaaagggctatttattattttttataactacagctgacccttgaacaacataggggttaaaggtgcagatcccccgtgcagtaa

SEQ ID NO: 45324 - DNA, 490 bp, Homo sapiens
cacaacatctttgccttgcctggcacccagcagctgcctctgaattcagagaggcagacagcaccctaaactttatcatgtaaaaattatgttatggaaaaaaatagttacagcttttcctttttattatgaaaatagcatatgctcttataacacattttggaaaaaaaattcaagaagcaaataaaactacacataagccaactgcacagtgataggactgttaatatttggcttacattttaatctagaattttcacagtgcacaaatatatgcatgttactttacactattaaatgtatactggatttttgtgggactttttttgctatatgattgtatcatccactttttacaatgaacattgtaccataagcttattttaataagccatccttttgttttttcttctaaagttgggtttgctgcgatatctccaatgctaaaggtctgttcctttattcagcaaacatttgctgtgtgcttctc

SEQ ID NO: 45325 - DNA, 1193 bp, Homo sapiens
caggtattcatgccttctccatcatagaaaattttaacttagttttttagtgacactcatatattgtgtatttagtgacactcatatattactgtaagtattagtctctttctcactggactggaattattcaggagaagggacatggccttactcagtgtctgccacatcgtgagctcagtaaacaacaatacagggcaaagaccctgtgcttatagggtgttacagggtgttggggaatttttggttttttttttaagttttttcagcaaatcagtttattgaccagctcacaagtgttatttttttcaaaagttaacttctcttggtgttcactttaacttttggtgattcatacaagttttctaaaaagcacatgtctcttagatctttagtttcctctctatataaatgtcattccctgcccctacacaccagggacatgcacagacacatgcacacaacatatataagtcttactggatttttgtgaaattaacaatattcatgtagtgcatccaccttggtctctggcacatagtagccatctcaaatgcttgttagggagattcaggcatatacaagttaatattataaagtcaatatgtctaaaaaaaataaaatttaaataagcaatttaaaatttggagccaagtataagaataaacagctaaaagccataagtagccgtgaatggtggtaggagactatttttcattatgagccttttggttatttaaagaagaacaatgtgcatactttcattaaaagtttttttaacttatttaagctgaactggtgatatctattataagcagaagtagtcttttcttggtaaataatccagttagcaaacctgaatagtatttatgtcttatgaatcctgccagttgtttcccaagttatggtaaagtaacatagattaggtatcaaaaggactagaccagaatcagttgttttcttcttttcctgtagagtacctaacagaaatagtgagaatatatggcaacaagattagacacaaatgtgtggaagtctcccagaaaaatggtagcaccagatcagcaccaggaggccagtgttgagtaatagaaccagaaggccaacatccagacaggcagattagtctgaggctattttaagtgctagaaggtgtgacttcctttcatcttcctggttctatcttaagtgac

SEQ ID NO: 45326 - DNA, 446 bp, Homo sapiens
ccccaatttagctgggggcttgcaaaagagtattacaaagcagaaaaagaaaactcagaactcagttaatttgtcattatctgtcacaaggggttccttgctggtttcttctcttgactccagccatcccatgggttgatgcaatctgtggtctgttctgcctcaaatgagaacctctcttaccccatgaatgctgaacccaaagaaaacaaaagaactactcctttctttggtcagagagatgacaaattaaaattccctagcattagaaaaaaacaagtcaacaaactctcattgcccaaagacatccccaaatttcttcactacattatcttacttgcaattacactacaaattagctccaagaaatttagtcttccataagctaaacaaagtgatttttaagcttttattccacctcaatacagtgtcctctccatcacacc

SEQ ID NO: 45327 - DNA, 466 bp, Homo sapiens
agctgaggcaggagaattgcttgaacccgggaggcagaggttgcagtgagttgagatcgcgccattgaacttcaacttgggcaacagagcaagactctgtctcagagaaagaaaaaaaaaaacctatcagttgaataacaaaaccctttccttccttgctttaagtgaatctgaagatccaggagctgtgctgcaggtaccctctatgttgggtacccctggtttaggctgactagtacagtgtggttggctcatgtagacagcagaccctttattttagatacaactttttttctttttcttttattttttttgagacagagtcttgcttgtcacccagcctggagtgcagtggcgtgatcatggctcactatagccttaaactccctggctcaagtgatcctctcacctcggctttcctagtagctgggaccacaggtgtgggccagcacccctggctgattta

SEQ ID NO: 45328 - DNA, 630 bp, Homo sapiens
gtctgtttatgctactatagcaaaatacctaagattaggtaatgtataaagaacagaaatttatttcttacagttttggaggctggtaagtccaagatcaaggtgccaacaagtttgcttgtctaacaagggctgcatcttccagaggggaggaatgctatgtcttcacatggtggatggcataaaggcaagagagtcgaatgctgcgtgaaacctcttttacaaagacctcaatcccattcacaagggaggagccctcattgcctaatcatcacctgttaagggtcttgtctcttaattctgttacactggccattaagtttcaacacctgaaatttggaggagacacattcaaatcatagcagcaggtcactgattgttatctttattttacatataaggaaactgaggctcagcgaagtcatgtaattattccccaggttatgcaggcagcaaatggcagaggcagctcattgtttggtctttccataccatgctgtactgtagaatttggaaaggtttattgcatcaccagttagtaagtcaggaactatagctcccttggaattgctacatatgatgatgtattgattctgatagacacaaaataaactgacatatttatagtgt

SEQ ID NO: 45329 - DNA, 424 bp, Homo sapiens
atattttaaaaaccccggttgtcctcttcagtttagcccacccgagtaagcatggcccgcaggttcagtgaacaggttgcatgggcccagaatggacacaagttgcatgggccgcaatgtccaggattaagctgtcgtcatagacaaactaggttaatgtcttaatgactaagagaaaagagaaaatgagagggcaccatggaagtctcaaagggccgtgtgccactcttcaggggtaaccttggcagaaagcaaaagacctggaataaaaacagtttgtagaaaataacaacaacaaaaaaaatattattaccaacatcttggtcatctttaaatgaagtaaaatgaaaagtaaattaattattaggctaaaagaaggaaataaacaagaaacaattgaaaagatgctgtgatgcacagttaa

SEQ ID NO: 45330 - DNA, 1113 bp, Homo sapiens
ctagtgttgataaacaatgataaaatcaggattcaaacccagcagtcttaattctaaaattgatgctctgaatgtaataaaatgttcaacttctgaatggcatattattttactgaatattggatattttttcctcaaaggtacactaatgtgataaaaaggtgcatgatgaaatgttgctctcagtttggtgtttctaattttttaaagttgaaaaacagttttgtttcagctgattttgatagaaaacattgctaattcttatgtagacaatttaaagtcatatagaaagtataaagatgaaagtaaaaataatttataattgcactcatcagcatttggaatattatcattagtaaatatttgttgaacacttactgtatgttttacatatatatttcttacaaactttctaacctcaatttttctttttcccctccctttttttcaatagttttattctctttagttcttgactaggtttttatgcatatgtagaatttggagtattatcactacttaatagtattgaatacttactgtgtattaaacatgatactggatgctcttatcaggggtccccaacccccagaccactgacctgcacttaggctgcacagcaggtaggtgaggtgagcaaagggtgaggagtgaagccaagctccgcctcctgggtcagatgggcaggagcattagactctcatagggagccacgaacccctattgtgaactgtgcatgcgatgggatcctgggttgtgcgctcccttatgaaaatcctaattataaatgtaatgcacttgaatcatccctgaaaccatgcccccctacccccaccccgcctcttacccccctacaggtccattgaaaaattgtcttcctatgaaactagtcccttgtgcccaaaaaggttggggacccaatgctgtatatgtgtgtttaattctcacaataattctatgagggagttagcaatatttaagtaatgtgcttaagattatacaattagtaagaggtgaaagtgagtttaggacttagggaatctgattcttgaaattttgatcttaactaaaaggctatactaccttcttagatcatagttctctagtagctgt

SEQ ID NO: 45331 - DNA, 448 bp, Homo sapiens
gccatctgtattatcttctaaaggctttatagtttttgcctttcacatttaagtctataatacatctggaatttatatatacttttgaaatgggatctcactctgtcacccagactggagtacagtgacacaaacatggttcactgcagcctccaccttccaggctcaagagatcttccagcctagcctcctgagtatctgagactgcaggtgcttgccaccccactcagctaatttttatatgtgtgctatatattttatttttttgtagagaccgagtctcgccatattgcccaggctggttttaaacctggactcaagcaatcctcctgccttggcctcccagctacttgggaggctgaggcaggaggagaatggcttgaacctaggaggtggaggttgcagtgagctgagatcatgccactgcattccagcctgagtgagactc

SEQ ID NO: 45332 - DNA, 215 bp, Homo sapiens
ctggagaaaggctacttggacccagtgggcagagggcagggatgctgctatgcatcctgcagggcacagggtggaccctacctcgatgaagtacccaactccaatgcccacagtgctgaggtgcagaagctggcttaacacaggctatcacatcaggtttcgtgcacattgtaggtttgtttgatttgttttgttttgttttgagacggagtctc

SEQ ID NO: 45333 - DNA, 397 bp, Homo sapiens
taagtggaaataaccaaaagttgtttagtgcccaggtgtgtgacccaggagactgagcaaactgagtaggtaatagcagcacctttttttttttggtccaaaacaaggtgtggcaccaaattaagaaattgatttccttgtttggtgtataatgaagtctaagatcaattcataaggggaagtaaagtccaaaaatgctatgagcaaatttggttttgttggcctaggtgtgtagggtccactttttgaatgtataggattttgcaggtgaattagaagcaaatgatatgtgattagaggcaaaccatttacattgcagagttttgcctttcctttcagaaaaaataaagttgagccagatgagctctcactgccttcttagtcatggagtttgatg

SEQ ID NO: 45334 - DNA, 1318 bp, Homo sapiens
tagggtcagaaaatataaggctcagaaggatccagaataatttcctctaaacccttcattcacagagtaaataaaatgaagctaccaatgtcacaggtagctaaagttagggcttggtctagaaatctcctccttatttaaattttctttattctccactgaacaaagagaaattggaagaatgcaagagatctccccacttcagacctacagtccacctcgccacagccagtcttcaaaagaggcaggtggagagccacgtgatggcattttcagctggtgcaaaggatcttccctgccctttcagaatgccccttcttcatgcctgcctccctggctcacacagaataaatccactcctttgagcaaagacactctatcctgagaaggagtcatctgcaaaattgtatgcttttataaaggccaggccaccatcaaacattaacatgccaatataggtccaatcaagcaaagctgatttccaagaataggaagctggactaacgcagatgacttgaggctccacacagggcttgcacacaactggagtctacagatatcatttggcttgaaaagaattgaatcatattgatttctagacaaggatcctaaattgtattgcctctagaccttcagctagtacctaaagcaaaatcaattgctctagggaaaaacaagtttgtaaggacaataataacatgcaagtaaatacgtttttactaaggaatgggagggtctctcacaccaaaaagaaaatgttttactattatgaatggtgccacaataaacatacgtgtgcatgtgtctttatagcagcatgatttataatcttttgggtatatacccagtaatgggatggctgggtcaaatggtatttctagttgtagatagcaaagagttggaaccaacccaaatgtccgtcaatatagactggattaagaaaatgtggcacacaggtaccatggaatactatgcagccataaaaaaggatgagttcatgtcctttgtagggacatggatgaagctggaaaccatcattctgagcaaactatcacaaggacagaaaaccaaacaccacatgttctcagtcataggtgggaattgaacaatgagaacacttggacacagggtagggaacatcacacaccgggcctgtcgtggggtggggggaggggggagggatagcattaggacatatacctaatgtaaatgacaagttaatgggtgcagcacaccaacatggcacatgtatacatatgtaacaaacctgcacattgtgcacatgtaccctagaacttaaagtataataataaaaaaa

SEQ ID NO: 45335 - DNA, 809 bp, Homo sapiens
ggcacgagggaattgttgagtgggacctatgacgtatagcaggatggatagaatatgaggcagatgggtcctagtttgctaaagagcttgggccgtctgataagttgtctttcttgccaaacaagggagtcacgtggggtatacacattgtataagcttttcagtcaccgaggttgcctgtccttcctgcctccctgtttcgttgcctccttgcctcccttcctcacttcccttcctttcccacctccctgtccacaccccttccttcccctgcctctcttcgtttccctttccttcattctttcctgccctcctgcctacttccctgcctcctttcctttacctcttgtcttagtctattttctgttgctgtaaccacagattggataatggataattttaaagaaaagagatttatcgctgggcgtggtggcttatgcttcaaatcccagcattttgggaggccgaggcaggaggatcgcttgagcccatgaattcgagaccaacctgggcaacataataagaccccatctctacaaaaaaaaaaaaaaaaaagtaattaagtaaaagaaaagagatttatttggctcatgattctgaagactggaaagtccaagaacatgacactggcatctgttgagggtcatcccatagtaaaaggtgagaggatgagagcacgtgagacagaggaagttgagctgaattcattttttctatcaagagcccactcctgtgtccagtgataatgtcattgatacctacctcttaaagggtccaccttccaatactgttaggatagcaattaaatt

SEQ ID NO: 45336 - DNA, 243 bp, Homo sapiens
ctattgttacttgaaaatgtagattaatatatttaattcaaccttctggacgaaacagtgctagaactatgtcatactttaccaaatccatcccttcccaataacaaaacaaagaaatgtttccctttccttcctggattcttcaggtgcttttcatcaacagaaaaccacttgctgacatgtggttcatttctagggtggacaagtaatttttaaaaatttattgtggcaaagtcagcatac

SEQ ID NO: 45337 - DNA, 345 bp, Homo sapiens
agagacaagttaaaaagaaatatgtgtatgtgtatatgtatgtgatatgaaatgagcaaagttttcacttccatgaaaaaaggtacttgtgtttgagaatgttttcaaattaaagaaaaagtttaatattaagtaaatatttggtataaaaattcacctaggttaatgtcttttaagcttttttggtctaccctcttgcaaagaaatagtattatttgatttacaattaacttctgaatcaaatgttaacatttcatatgccattaaatacatctattatagaaatggttcttttgatgaatttttatagtggcatgctgtcgtattaaccagaaatacaacatt

SEQ ID NO: 45338 - DNA, 389 bp, Homo sapiens
cctttcaaaaataattttctgattagttcctgccccacctggtggttgtgggaactagacgagcgtccgtgcgaagggcatgctcttctccagggtcacttctgaatcaggctggagcctggcatgccccatcaggcagagtagggaagggccctcttggattccagtgcaaggcgtcctcagtgtgtgcagtgcccatctaggtggtatttcccagcgtgtgagctgagtaagatgagcccgcagccattccccctttgcaggctctccaccagcatctcctcttaccatctgtttgcctcctgactaaggaaacaaggccatttctgcccacatttaagctttgaggttggcccagtgcactccgggtggctgccgacatcctgggc

SEQ ID NO: 45339 - DNA, 351 bp, Homo sapiens
agttattatacatacatatatttccttgctctgtcaaataacaataacaatagtaatgagtacccctagcacccagactgtggtttctaataccattctcaaaaaaaaaaaagaaatcagaagtccttggagaaatggctgattgtaggactggggcaggaaattaaatgaagagaagatgagcctgtaaatctgagggagtatatcagagggaaataggaacaaacagagagatctccccatggcccaaactggatcaatttgaatgacaaaataaatgagcccaaaggttaaaataaattaccatgaatacaagatgaatgcataaataaataattgaaaaaaatggga

SEQ ID NO: 45340 - DNA, 408 bp, Homo sapiens
agcctgtcaaatgtattcttacaattcatgtcatcttgttaatagcaggacttcaaagtctttgcatatttagagctgagttttgctgagactgtggccattcctaatgaggtttcctcattccatatatataatagctaacccttaaagccattaactaatgaatgcatttattaagctatccactcgcatggtaccctgctgtggtgatgagcagtaactttctagctattccatagcccaacatcaaaggaaatcgtgactcgtcctactagaagtgtagtgtctttgtgtttgttgtgtagtgtcctgtgatcaatataaaatctatattatcagtgttgggttttcaggggagggagggagaggatgttaaagtctctctttgataaacttaaattatgaaat

SEQ ID NO: 45341 - DNA, 353 bp, Homo sapiens
acacatttatatatcctgttttactcattcctaaaagcaagaaagagagggagataaagaaggaaggacaggaaaggaaggaagggagaggggaggaaacctaggaggcacagatttctgccccttcacagatgaagaaactgcagctgggagaagtgaagtcccttgtccaagactgcatggctaagtgagggtcaaagtcaggactccaagtccctgttcttccctccttccttcgtccttccttctgggtctgaaaccctccccctggcaagtccgtggctatacttttcccagttcccaaacacagccctggtgtatgaagggtgtccctggggccttcacccttgctt

SEQ ID NO: 45342 - DNA, 418 bp, Homo sapiens
ttgccaactcgcatatctgtgtagtttttctagtcttttaataagtgtctgtacaaaactttctcataggagtctggaaatggagaagctatgttttagcatctggcataaattcagttgctgttctaccatttcaatctgttagcgtatttcttagctgtttgtacccattgacattttaggtaagggctaagagagagttttttccacaagattatcctttgtaacactgctctcaggcaaagaaattttgttgtcagcgttattagccattcacttattagtacattgcttcaaatttttataaggtgaagttatttcaccatagaaacaagtgttaagatgtttcctggtcaaccgatcaaagccaacatatgtacctttagttgcctcaagtcctcgagtgtttcaagaggag

SEQ ID NO: 45343 - DNA, 576 bp, Homo sapiens
ttgctaaaggcctccagtctccaactcctggggaagaaggatccaggcctctgccgcacaaagcctccactgttctcttggggctggcaccccttcctgtggccctgtggcaccaaacaaattgattcatccagcgaatatttcttatttactctgttccacatggtggtgagtgaatcaaccctggactctccccacaaaggacttaagaacacgcaggtcatgaacaaatgaacacttttgcataatttttatgaccaacggtgaccaggccaagagcaggatgaggtgatggagaataccttggcctggggcatcggaggaaactcttgcgaggatgtgctacctccgttgaaagtgggaagatgagagaccggctgtaagaggagcaagggaaggaggttctggaatgagagaacagcacgaacaaaatgcccgagacaggagcgagcttggcaccttcaagaaaataaagaggagaatcactgaacctggcacgtggaggttgcaatgagctgagatcgcgccactgcactccagcctgcgagacagagcgagactccatctcaaaaaaaa

SEQ ID NO: 45344 - DNA, 734 bp, Homo sapiens
gtatgaggaagagagaaacaattagaagttctctgtcacacaatctacacactaccaggaagttattctagaaaaaataacgttctctaaaacgaaccatgcaatctgacacccgtcttccacctctcagggaagagaaacttcaaaggcaggaggcagggccaatgcatgatgtgttctattgtcccaaggagacctgcctgagccttgaccctagtttctgatggctttccgtgttgagtgtagcctaagaagcagaaactgaatctactggaacctttctgaatagggtttatttaatcacatgcactgtttcctgtttaaagcatttcccaaaatggcatagcacctcctctccaatggtggtcaaattgcgatgtgtacccttgggggaacttgaagaatttctatgatgtacatgggcaggaacagcttgaaaggaccaatttctgagtctcagcttccatttgcactccgtaaaattgacctacctgggaatgtgtctatggtctgctagtattccagtcccccttctcctagcatacaaaataaggcagacttctcacccatcccaaaacttttatgttgtgtagggtgcaggggtgaggggctgtacaaactctctgaaacacaaaataaaggtactattcagccttatttcatccagatacccagattcataccttgattaattagctatctatctattgctgcatagaaaattagcccagaac

SEQ ID NO: 45345 - DNA, 763 bp, Homo sapiens
gaatctggcatacagaatatctgggaaggggtttaggtggtgagcacaataagagtaaatgtcctgaagcaggtgtatgcttggcatgtttgagaaggagaaagaacagtttggctggaacagggaatgggagggagaatggctggagatgaagtcacacagattacaagagccaatttttgtagggtctttagagtttggactctttccgtgcgtgaaatatgtggctcttggaggtttctgagcaagactcacatgacctgattcatgtttaaaagatcactcaaatgttcctggctttaatgtatacttaaagctcatgtttttcaagttaccttttccccagaatagcccatcggtattttaaactcaatttccaataaacgaacagacacgttagaattgtcatccttgaaatactaagctttgcttccagaaaacatacaatatcttcttactcattcatgccctttatacccttattaatgttttcagatcaggcaggtgtggaggctcatgcctataatcccagcactttgggaggccaaggagggaggtttgcttgaggccaggagttcaaggctagtctgggaaacatagtgaggccctgtctctacagaaagtgaaaaaatttagccaggtatggtggcaggtgcctatggtcacgcctactgagctgaaaagctgaaatggggagaatcacttgagctcaggagtttgaagctgtagtgagctatgatcatgccaaccgcactccagcctc

SEQ ID NO: 45346 - DNA, 780 bp, Homo sapiens
  misc_feature (776)..(780): n is a, c, g, or t
ctccactcccatcagcagtatgacagtttacaaatgctgtggcaatgtcaggaagttacccttatggtctaaaaaggggaagcatgaaataatctacccctttttagcaaataatcaagaaaaagccacaaaaatgggcaaccagcagcccatgctgctgctctgcctatggagtggccattttttttattcctttactttcttaataaacttgctttcactttactctatggacttgcctcaaattctttcttgtgcgagatccaagaaccctctcttggggtctggattgggacccctttctggtaacagcatcttttatctttgctgagacccacataaaagaaaatgagttttgtaccatggggtagcgaagaagttcctttaacagggagagtacatgaggttgacctaagtgggaagacggcagctcagagaaggtgaactctattgaagctgcaatatggctatctaagctgagtacttccctacatacattatcccattttacactcacaacaccccctgttgagctaagttttataatcctcttgttacagataactgagaagcggagctactcacttcggatcacacagctcctcactgcacagcaaaggctgattctacatgtcttggactccaaggctactggttttccctgtgaaccaccttgagattaggtggatgaaagatcaacattctaaatatttaagcttctgtttaggattgcttaggtagtttctggaataaaagtaagaaaaaaagacaaaaannnnn

SEQ ID NO: 45347 - DNA, 428 bp, Homo sapiens
tgaattaccaataacatcttgatggttttgttcttttgctttgaggggactttggtgctgaaaacactcaaaactctgcttttcacaggcagcacgtaaacaacagcaaacctggaagatgttagtccttcaagatgtgcaggttagcacactctggtttcattgtactctcttatgatccagtagcctcagatcccccagaccaggtatacttttataaatacatacagaaccaatcaatatttatttttgggtcactaaaactattctagcaaattccttaataaggtctctagatgaaaatacatctgaaaccaaagaatagttttgctttcacaacttccagttccgatattttaaaacactgatttaaaccttttcatatgtaacaagtgagactcgggggggaaccctgtatttcaccttgc

SEQ ID NO: 45348 - DNA, 614 bp, Homo sapiens
ctgggtatatctccagaggaaataaaatcagtctctcatagttgtgctcccatgttcatggaagtgttaatcacaatagctaagatatgaaaacctaagggataaaggaaatgtgcgatgtgtgtgtgtgtgtgtgtgtgtgtgtgtgtttagagagagaatgagaatagcatattctgccttaaaggaactcctgccatttgcaacaacatggatgaagccaaacatgtgtggcttcacttacatgtggactctaaaaacattgaattcatggacgcagagagtagattggtgcttaccagtgcctggcggtagtggtggagagatgttggacacaggatacagacttccaattataagatgaataagttctagagacctgatgtacagcttggtggttgtagttaataatgctgcatttattgtatgcttgaaatttgctaagagagtaaatcttaatttgctaagagaatagattctcaccacacacaaaaaaggcaactaagtgaggtggtggaggtacatgttaattcacttgattgtgataatcatattacagtgtatacatatattaaaatatcatatcacatacattaaataaaaatttaatatta

SEQ ID NO: 45349 - DNA, 860 bp, Homo sapiens
ggagttaaagagtgagtacattatgaggaaagggaggtgagtacagaccaaccatctaaaaaatctggtaatgaaaaagagaagcaacggctggaaaggggaataggaccaaagagcagcctgcatatagttgagcacagatgaaagaagccagtaagaatggaagtgaaagattgacaataagggcagttaattctttttgaagtatacagtaggctgggcgcagtggctcacgcctgtaatcccagcactttgggagctgaggtgggcggatcacctgaggtcaggagtttgagaccagcctggccaacatggcaaaactgtgtctctactaaaaatacaaaaattagccaggcatggtggcgggtgcctgtaatctcagctacttgggaggcaggcaggagaactgtttgaaccctggaggtagaggttacagcgagctgagattgcaccactgcattccagcctggtggatataaaaataataataaataaacaaacaaataaataaaatatagagtagactctctttagattgtaaattccttgaggacaggaatcttgtcttattcatatttatgtccctttctatagcacctagcacagtgactagtatagtataatgcacataatagataaaaaatagaaacaattgaattgaattggcctccctggtatggtcagggatagctgaaaggcacagaaggactccttacagtgatggggaaggatggatctttctctaagcccaaaggaaaggaagacagaggttgttgtaaagaggtggcagtctttctggagggggacagagaagtggtaggaggaatgacaccagcctactgtgtggggatgtcggtatt

SEQ ID NO: 45350 - DNA, 1232 bp, Homo sapiens
cggaggcgaaagcggcccggggatcctcccgccgcctgcgcggccatcgcggtcatgggcgccagccgcgcgcagtgcccccgggtccaagtcggggtcgggagccacgcggcggccaagaggtggctgggaaagttgcggcggaagcgccggtggcggcgggcccgggaggcgggctccagagatccgctgccctccgcgccactcccggacccgccggcgcccgccgagtcccctaaggagctggacctgggcgcacagcgggagcgctgggagacgttcaggaaactgtggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccaaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtaaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcgataaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcgtctggtgtgtaggacggcaacacacaaacagtttgtaaacatgtgctaggacgtcttccattcat

SEQ ID NO: 45351 - DNA, 721 bp, Homo sapiens
ataaatttaagaaaactgaaattataccaactaccctttcagaccgtgtggaataaaactggaaatgaactccaaaaggaaccctcaaaactacacaaatacatggaaattaagtaatctgctcctgaatgacctttgggtcaaccatgaaatcaagacagaaatttaaacagtatttgaactggccaccgcgcccagccgtttaggggtgcttttatatgggagaaacagcctggttgcacataaatttaaaacaactaaggcaagcacccatatgtaatgagaatctccactcctttctgtccaaaggctgagtgcaccagaatacttcaatctggaggaaaggaaaaaaaacctttatcctgagggaatgtgagccctttaaatcatcagggccccgagaaaggcatttaaaatgtgaccacaatcaggtctcactctccctggaactgaataatgacctcttgaagccacttgctatgtgggctgcagatgaatgccaagttgcaacaatgtatagccaatcactaaccaatgttatttctgtaaactaatgaaaattcctgatgagcagctttcgtaattgcttctctcatgattcttccttttttctttaaaaacttgaggctcttctttgtcctccagagcactccccaaggcaacttggaagtgcatccatggctgcagctctcaaccttggcccaaataaactctctatatt

SEQ ID NO: 45352 - DNA, 384 bp, Homo sapiens
cttagaaacaagtcaggaaataacgcctagatcaggtaaggtaggatgttttcatatagagcattcactttttggttttaaggggcatagaaaggtgactaaaataattggttgagaatacacacataattatttttacacaaaccccaaagtgtgcagctagcctctggagaagcaaaagtccagcatattttgttgcctaaagcttagtgggatattaatgtgcatggtaaatattcagtacttttgaagttcgattttgatattggttatccttatatgcaaatctcttaaaaaccatgttacgtggttttgaactttttgctcagtagggaaatgtatatgtatttttccagaccaaaataaattacatttttccttttc

SEQ ID NO: 45353 - DNA, 451 bp, Homo sapiens
gccacaattgtaacaacactcactttcagatgttctctagctctcccaagagatatagcaccttcatgttcaaatatatacaaccgttatcattcagctgggcagttagtcatcctccacacttctaggtcagactttataccatcaaagtgattttcacaggcaagtgctgggtaaaaaccactgatacatacacctattaaactggtttcagtcagtcacatattaggccaaattctgatacatacttactgaccattttgtcaagaaaatactgtttacagtgaatctccaagccacattcaattattttcaactttgccagaaggcaggttctgcctgcacagcgtggcatcaatgtgaaggcaatggtgctaatgagaagtggtcttgacccattaaagctaagaagttggcagtaccccaatttggacttcacttctaaagttct

SEQ ID NO: 45354 - DNA, 591 bp, Homo sapiens
gtaattgtgtatatgagtttcttaacccagtgcttggcatataacaagaactcaaaacctcttcctaaagttaaagttttagggtccgtagatttagtttgctgatgttctaactggatatatgaatcatcattatcatagctagctcatttttctttttctttttcttttttatttatttatttatttttttgagacagaggctcactctgtcacccaggctggagtgcagtggtgccatctcagctcattgcgacctctgcctcctgggttcaagcgattctcctgcctcagcctcccaagtggctgagattacaggtgtgctccaccatgctcagctaatttttgtattttcagtagagacagcatttcaccattttggccaggctggtctcaaactcctgacctcaaatgatccacccacctcggcctcccggagtgctgggactacagacgtgagccaccgcacccagctgctagcttgtttttctaaccacgatttgaatacattaacccaatatttataccaaccttgttacataagtactattgttgttatattataaatgaggaaattgaggcacaaagagg

SEQ ID NO: 45355 - DNA, 1540 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45356 - DNA, 580 bp, Homo sapiens
aaaaactgggaggtcgggcggtattcgataaagcttgatatcgaattcggcacgagggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45357 - DNA, 1572 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaaaaaaaaaaaatttactggcccgcgtttaccgc

SEQ ID NO: 45358 - DNA, 1866 bp, Homo sapiens
  misc_feature (1615)..(1615): n is a, c, g, or t
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaaaaaaaaaaaaaaaaaaaaaaaaaaaaaaaaaaaaaaaaaaaaaaaaaaaaaaaaaaaaaaaaaaaaaaaaacatnaaaaaaaaaaaaaaaaaaaaaaaaaaaaaaaaaaataaaaaccctaaaaaacaaaaaaataataaaaaaaaacatttttctccccctcttaccaaatctttttaaaattttaacaatttttattttggggcgcaataattgggctctttttggcaatttcccctttttggggggtgtttacaaataacgggcggctgttcaaaaggttggacttggaaaaacctggggttcccaaattataagctttggga

SEQ ID NO: 45359 - DNA, 1483 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaggttgcagtgacctgcacggtgttcccacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45360 - DNA, 1486 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacatgttaatgaaagtgcctgaaagaccttccttaataaagaaggttctaagctgaa

SEQ ID NO: 45361 - DNA, 1486 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45362 - DNA, 1429 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaggttgcagtgacctgcacggtgttcccacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45363 - DNA, 1494 bp, Homo sapiens
  misc_feature (1494)..(1494): n is a, c, g, or t
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacatcctttcttttttttttttttttttttttttttttttttttttttttttcttatgatccaan

SEQ ID NO: 45364 - DNA, 1728 bp, Homo sapiens
  misc_feature (1571)..(1571): n is a, c, g, or t
  misc_feature (1573)..(1575): n is a, c, g, or t
  misc_feature (1577)..(1577): n is a, c, g, or t
  misc_feature (1583)..(1583): n is a, c, g, or t
  misc_feature (1586)..(1586): n is a, c, g, or t
  misc_feature (1588)..(1588): n is a, c, g, or t
  misc_feature (1594)..(1595): n is a, c, g, or t
  misc_feature (1597)..(1597): n is a, c, g, or t
  misc_feature (1599)..(1599): n is a, c, g, or t
  misc_feature (1604)..(1604): n is a, c, g, or t
  misc_feature (1610)..(1610): n is a, c, g, or t
  misc_feature (1613)..(1614): n is a, c, g, or t
  misc_feature (1617)..(1618): n is a, c, g, or t
  misc_feature (1630)..(1631): n is a, c, g, or t
  misc_feature (1645)..(1645): n is a, c, g, or t
  misc_feature (1660)..(1660): n is a, c, g, or t
  misc_feature (1662)..(1662): n is a, c, g, or t
  misc_feature (1670)..(1670): n is a, c, g, or t
  misc_feature (1676)..(1676): n is a, c, g, or t
  misc_feature (1679)..(1679): n is a, c, g, or t
  misc_feature (1685)..(1685): n is a, c, g, or t
  misc_feature (1688)..(1688): n is a, c, g, or t
  misc_feature (1690)..(1690): n is a, c, g, or t
  misc_feature (1696)..(1696): n is a, c, g, or t
  misc_feature (1703)..(1703): n is a, c, g, or t
  misc_feature (1705)..(1705): n is a, c, g, or t
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaaaaaaaaaaaaaaaaaaaaaaaaaaaaacatngnnnanaaattnatnanaaaaannanangaaanaatgantcnntannaaaaaaaaactnnggggggggcccggnccccaattggccttnangggggtcntttacnatnaacggnccngngtttanaacgttnanactgggaaaaccctggggttacc

SEQ ID NO: 45365 - DNA, 1823 bp, Homo sapiens
  misc_feature (1615)..(1615): n is a, c, g, or t
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaaaaaaaaaaaaaaaaaaaaaaaaaaaaaaaaaaaaaaaaaaaaaaaaaaaaaaaaaaaaaaaaaaaaaaaaacatntagccctcctggcccaaaacgattttaatctggcccaagtttatgattgcgtccgcaattcggcctaattgggccatttggcccaatggggggccggttaacaatcaatggcccgacgtttaaaaccgtggggatgggaaaacccttggggttgccaaactaaatggttttgcagcaaatccccttttcccaaggtgccgtattacca

SEQ ID NO: 45366 - DNA, 901 bp, Homo sapiens
caaagacaatcctagtgaggccggggccaacataggccagtcacccctccttgtaaccttgatgacaatcccttgtacttgggtaggtcctttcttgctagactctttgcaaatatcttgcctgggaggaggaagcaaactaactgaaggaaatggtcctttttccagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45367 - DNA, 1486 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctgaa

SEQ ID NO: 45368 - DNA, 451 bp, Homo sapiens
gagcctctatagtgtgaatactctggacaaaaagatgattcacaccccggcaggcagagcaggatggctaagatttcatcatgctactcagaacacggacaacttgaaatttatgaattatttctggaattttctgtttcatatatttggaccttggataagggaggactactgcgtctgaagagtcagcgatacaaattcatacatcaaatgcgtgtattgtttggcagatggcagctgcttacatccaatgataggccagcaggtgattctgtgccattgagggtgcatttacacatccatatgaatggtacaatcacatgcagtgataaccgtcaaccacatgtgattgtagtcagtttttggagacagaagacttgggtttgaatccatgcccgttagttgtatgactttgcatgtgttatttaacccctgagcctcagtttaccca

SEQ ID NO: 45369 - DNA, 521 bp, Homo sapiens
  misc_feature (521)..(521): n is a, c, g, or t
ggtgtgccatcacagcaaaggtagggtgtggccagtcctgggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagccattctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgacttaaaaaaaaan

SEQ ID NO: 45370 - DNA, 2046 bp, Homo sapiens
  misc_feature (2046)..(2046): n is a, c, g, or t
gcggctcccggggcgccggccctcccccgcccccacccccgcggtccctcggaccagcgctggaggcgcgtggtgtggacgcgcgcttcggagttggagggcggcgcccaggaccctggtgggagagtgtgtgcgtcgcgctggagggcgggaggcgggggcgggaggtgccggtcgagggagccccgctctcagagctccaggggaggagcgaggggagcgcggagcccggcgcctacagctcgccatggtgcgccccctgaacccgcgaccgctgccgcccgtagtcctgatgttgctgctgctgctgccgccgtcgccgctgcctctcgcagccggagacccccttcccacagaaagccgactcatgaacagctgtctccaggccaggaggaagtgccaggctgatcccacctgcagtgctgcctaccaccacctggattcctgcacctctagcataagcaccccactgccctcagaggagccttcggtccctgctgactgcctggaggcagcacagcaactcaggaacagctctctgataggctgcatgtgccaccggcgcatgaagaaccaggttgcctgcttggacatctattggaccgttcaccgtgcccgcagccttggtaactatgagctggatgtctccccctatgaagacacagtgaccagcaaaccctggaaaatgaatctcagcaaactgaacatgctcaaaccagactcagacctctgcctcaagtttgccatgctgtgtactctcaatgacaagtgtgaccggctgcgcaaggcctacggggaggcgtgctccgggccccactgccagcgccacgtctgcctcaggcagctgctcactttcttcgagaaggccgccgagccccacgcgcagggcctgctactgtgcccatgtgcccccaacgaccggggctgcggggagcgccggcgcaacaccatcgcccccaactgcgcgctgccgcctgtggcccccaactgcctggagctgcggcgcctctgcttctccgacccgctttgcagatcacgcctggtggatttccagacccactgccatcccatggacatcctaggaacttgtgcaacagagcagtccagatgtctacgagcatacctggggctgattgggactgccatgacccccaactttgtcagcaatgtcaacaccagtgttgccttaagctgcacctgccgaggcagtggcaacctgcaggaggagtgtgaaatgctggaagggttcttctcccacaacccctgcctcacggaggccattgcagctaagatgcgttttcacagccaactcttctcccaggactggccacaccctacctttgctgtgatggcacaccagaatgaaaaccctgctgtgaggccacagccctgggtgccctctcttttctcctgcacgcttcccttgattctgctcctgagcctatggtagctggacttccccagggccctcttcccctccaccacacccaggtggacttgcagcccacaaggggtgaggaaaggacagcagcaggaaggaggtgcagtgcgcagatgagggcacaggagaagctaagggttatgacctccagatccttactggtccagtcctcattccctccaccccatctccacttctgattcatgctgcccctccttggtggccacaatttagccatgtcatctggtggtgaccagctccaccaagcccctttctgagcccttcctcttgactaccaggatcaccagaatctaataagttagccattctctattgcattccagattagggttagggtagggaggactgggtgttctgaggcagcctagaaagtcattctcctttgtgaagaaggctcctgccccctcgtctcctcctctgagtggaggatggaaaactactgcctgcactgccctgtccccggatcctgccgaacatctgggcatcaggagctggagcctgtgggccttgctttattcctattattgtcctaaagtctctctgggctcttggatcatgattaaacctttgacttaaaaaaaaan

SEQ ID NO: 45371 - DNA, 402 bp, Homo sapiens
tttttttttaacgctattttatttttgagatgaagtcttgctatgttgcccaagctggtcttgaactcctgagctcacgtgatctacccaccttggcctctcaaagtgctgggattacaggcgtgagccactgtgcccaacttaaaaaacaggttttgaaagcaagtttgataaagcaatttattacaattttctcttcttcaacaagctattatttcagctctaactctggtcatatacttgtttttggatctctgcttctttttctggcaacatattcaagaatttaaatattcactaggctttatggagcagtaaattcggaataatgtttaaacaaatactcctaaaatatttttcaacaaatgtttgtaaatggatgttgaaagtaagcctgtttta

SEQ ID NO: 45372 - DNA, 427 bp, Homo sapiens
cttgcgtgggatccagggggggcctgaggcccccaattctttgggaagcttgaacaatgacatctttctggggtgatgggaagacaaaagtgactccatcttggatgctaattttcccatgttgacttctgattagccccagtcccatgaatgcctcctgactcctactttatttactgtcccgagtgtaagaatatgtactcctgcttttagatcaaagcaagcttgatgttatcatgcaaattctgggctatgatgcacatggcgttcttgcctgctctggcacactacctttcactgtcttgctggagcatgtatatccttttcccttggtatataagccttgggtccgagagtaacagtgcagagatctgcctgtcttgtggccacccgagaccacccgcctgcttaaaagttccctcaataa

SEQ ID NO: 45373 - DNA, 422 bp, Homo sapiens
tgataaggatgtccttctctgcctattagtggttttaagttaaagtaatactaatttatacactagagtataaaatagaaacgctaatttttctgcagcagagttatacagttcacagaatgtttattatatcattattattttatgaattaacagttttttccgagaacatagattggactataaggggcagacatttgccttaataaggtgatcacacgtcaacttactgtgtggactagatgagttttagggtgtccttctaatccagagagtatgggaggtatttagcatgatttatatagtaagtcttggcagttgaattttcggaaactttgagttattactgtttattttgctgtttaacgtttttagcatgatgcactgaggtgttgtgaatcctgaatcagcaatgttcaacc

SEQ ID NO: 45374 - DNA, 463 bp, Homo sapiens
  misc_feature (39)..(39): n is a, c, g, or t
gggtctcactctgtcacccagactggagtgccatggatntgacacagctcacagcagcttcaatctcctgggctcaagggattctcccgcttcagccccttgagaaactgggactacaggcatgtaccacagggcccagctaattctttaactttttgttgagatggggtcttgccgtgttgcccaggtttgtctcaaactcctggcctcaggcaatccttctgcctcagcctcccaaagtgctgggagtacaggtgggagccactgcatctcggcccactttttcaagaatttgatataagtggtatcatccagtatatactctcttgtatgtgggtttcagctcagcatgtttcagagatgcatttgtaatattctgtgcagtaggttatttcttcttttctagtggagtagtgatcccttgtatggatttgctacaatttgtttatttttgtcctattca

SEQ ID NO: 45375 - DNA, 456 bp, Homo sapiens
tggctccatctgctgccttcttccttgcctctctcatcatccaaggctctattaataatctattcaaaaaggacaatgctctcaccccaataaagtgcccttccacatccacctccccagcccaccaccaaaaacaaatactcctcccccttgggaagtagccaagtcagcactaataggaggcagttgcagtgactatcataaacagccaaaactaatctgagctgccattccagaaaagccttggcaagactttgccaaagtcctcataccaatttcattttatttgtcacacattcaagagaactccagctgctatccaggtgcccatactactctgttgtacacttctttcctactgggtagggctgaaactttcaaagtctccaggccaatgcattagctcagcaacctctctctgctcttcactaagcgaaatcttcattccctggtgtt

SEQ ID NO: 45376 - DNA, 2627 bp, Homo sapiens
  misc_feature (273)..(273): n is a, c, g, or t
  misc_feature (600)..(600): n is a, c, g, or t
  misc_feature (857)..(857): n is a, c, g, or t
  misc_feature (1038)..(1038): n is a, c, g, or t
gagtcggacaagctggggcagggtaggggcctgtgtgtgtgtttctatcgattggccttgccttctcattgcagctgaccagacacaaaccctcgcatgtgcaatacagaagactcccccactggaaaaaaaagaaaaaagaaagaaagaaagaaagaaaaaaaagatggagggaggaaggctttaattttgaataatttccaaggacacagagaaaaatgaagtatctgtgatttacactaaagctcacaggcaactttctctctccctctntttcttcccccacagaagcagtcacgtacaaaacattaaaatataaacagagctgcagttgctgaagccagaacccttgtctgattttttttaaactccgtgtcatgctaaaaaaaaaaaaaaaagaaaaaaaaaagaaaaaccaacaccgtatctgaaaagcttagcacaatataactattaaaaaaatcttttggttggcttggttagtagtgtgagaatgaagaaacgtaaagacttccacgtctcaggaatatttcagataaaaaataatcttttgcggctccctgcccgggctcccagcagcctcttcccctttgtgtctgngctctgtcccctctgcagggccccagcagacccccaccaggcctgatgtggacagctgttcccaagccctgccagttaatcgcttctgggtttgcacccttgagctgtgtgcaccaggacacccccacctactggaagtactcagggacgcagcctggttcactgacacagcccccagctgcctgaggagtcggtgaagctctggcctttccacctcttctgctgcaagaggccttgcagcctgcttccctggtggnaaaaggaaagcagaaactctaggccttcctgctggatctacactactgggagagccccgatagtgcaaatttaattggcagggattctattaaatatgtgactttatttggggttgctaatgaaatcaaaggcttgttgtatgacttacagtgtggacattaatttttaagaatgatgggntagaaagttagaacggaagagtttttctacctaaagaaatgagaatctagaatttgtgaaagggctgaatgttcctatcttgctgcttctgggacaaacttttccctgacatgtaaaacgcctgcaactgccatgaacaggaaagaaatggaaatggtactgattcactcatcaactccaggcaacttttgttgtgtgtgtgtgtgtgtgtgtgtgtgtgtgtgtgtgtttattttgaaataactttattcgcagcctaacactttgcactgcattcagcatgacttagaatttacttttggtgttgtccagctgctgccaaaaattgggtagaatcagattggtattctttgttggtgcctggaatcgtagccagtggtacaaaggtgatgttgttccttgctgagacttcgtggaagaaggcaaaactttgatcatctgcccttgcacttgggcagtgttgaaggtgattggagtacaagtgccaatttgcaggaacaattgtaaacacctttgatacaaatgccatcatcccatttttactgattagaaaaactttgctattaataggtgcaaagtccatttcaggtataattggtaaggaactgagtgcactcatgggaagaaaccttgttttgttttttgttcgcttttcttcttatccccttttctcagttttatggctggagacatgatttattgcagccatccatcttgggggctcatccatcacacccgggttgctaggagattgtggcagcagctgtttgctctgaatcagacagaaaagttgtcaatcatcaaaggcaggtgaatagcattagaaacacgctattgtcagacggaataattaatcaaagagagaaaagataattaaaaagatatgacccttgcaagtacttgctctgggttgcctgtaaaaaaaaaaaaaaaaaatagaaaaaaagaaaaagaaaggaagaaagaaagaaaaaaaatgtgtgtgggcgcccccgcgcgcgccccagaaaaagactttcttaaaccccccgcggtgggggcgcgcgggcccccgggggaagggaacccgggcgccagcgggttccccaggaaaacctcggggtccaaaacaatgtgggtcgggttctctccccccccataaaaaaagaccccgcgggggaaccaccacgcgtttctgacacacaccaccaggaagggacgatccgcgcgacggaccgacgacggcgcgcattcacaacaacacggagagccaccagcacgagagcccagaaaacacaaattagacgccgccccccccgggacacacacacgacgaacacaacccaacaacagatgaacgacagcaccaacagaccaacagcaagacacaacacacccacaacgcccaagaaaaccacacacaaacaagcacataccacaaccaacacacaaccacacaacacacacaagcccagacaacaaccaacacacacaccaacacaccaaacacagacacatcaaacaaacacccacccaccaccatccaagaaacacaccaagaaaacagaccaccgaacacgacaacagaggacacacaccacacccagaca

SEQ ID NO: 45377 - DNA, 417 bp, Homo sapiens
gctgattgtgtggagcaggctgagtagcacatggtttctggccagtgatgttcatttgtgtggccaggtctcaaattcaatattgtttttaagaaaatctttctgaatgaagaagtctccatggactcttactccataaaaactaagattctttgcagagtttcactgggcagcagttccatgtctaggggtggaggtttggcttctgtcagactgttccacagggcacattgaagtcctgggtgctgggcagggctgagattcccaggggagcacccccagggctgggtcctagggcgccttgacactgttaaaaattactgaaggccccaaagagctgtggttatgtggctgtatatattgaaatttactattttaggaattgacaggcatttaaaaaatattttttctccatgt

SEQ ID NO: 45378 - DNA, 2212 bp, Homo sapiens
tgtggttgagtcttcacgaacttcttgtcatcaggcaatagttgattccccttttttgaaagctttcaatttcatttatccttagtgttgaaaagtgtcagaaaattgaaatggacacagatgattgtatctgccctccctttcaggaaagccatgttgactttaaaatatcaaaaaagaaagttcagttatgattgcagggggtaatgatagtttgatccacaaactatttgcagtgtaaaagtgaaataccttagctgacttagttcatttttgaaagttttgaatagctaaaacaaagttggcaaataggctcatagagtagttacagagtaagactaaattcatatttgatgcagattcctctctacctcccattctgggaggatttagttttactgtttggtgtttaggataatgattgttctgtttttctcaccctactatgtgaatatatattctgttagagatgggctgttatctgcaatgtggactcaataccatgggcttgagtttggttagttcatcattagagattttttttcagcagttggtttactttatgagaaaggatcatgagtttaattttcccactgatatatttgtgttctcattgctgagatataagtttcttaatgatttgttacctttttctattttcctagactagtattaaaattttgatggcatatgggtttggttccacttgtagagaataaatgttcacaacttactggtattagcacacacacatcacatgcagaaatggtgttttcttgccacttactctttctcataagatgcttatattcctgtgggcatttgtcttccacactacagcacataatttgatgaaactgattttctgtgcaagagcttgtgtttctccaactctggttttatggaccacttttcattggtatataggaggcggttaaaacgtggtggtagaatgcaggttttaggttagctggggtgtgaagaatcccaggtctttgggatagtctttggcaagttactcaactcctctaagttagtttcttgatctgtcagatgacagtaaacctcagagtgtgaaaattaaatggatataatgtgtgtaaagcacttagcataatgctttatacatcgtaaaactttcaaaaataggagtagtaattattacaaagaaatgtgaagaagagtcctagtgggctgcatgttaaaaatagtttttagttaatgaaaattaaatcacatcttagatgtttatcatctgcatggtacttttctggttgctgctttaacctttgtatagttgaaagtctgtaaactttctagtattctttgatttctggcccatttccctcctaccattcacgcttatattttttggttcaagtcaccattccttgcaaaactaattaaatacattcctaaatacataatattgccaatattcattcacatccaccacgtctagatccaagtcttcatcttctttatgctggtctaatttttgctgagccttagaagcaaagacagactccgggggttgatatgggacctccagaatggggattgcacagaataatcttatttttcctctattcttctagtctgttatgttctgaacccacacatgttttcggaaggaccagatggctgacactggctaatgggaaccaaaagacgagtgaaagtaacctggttgtcacatacccccagcttagaggtgcttcaccctgccccaaggtcaatttcttttttctctagagactttaccccattatatcaaaaacctttactacagcctgactttatctgatgttagagtatcattaagtcaagcagcagcatttattgagtgaaaaaagattgtacacaggactggaagagaagcatctgcctttaaaatacagtagaaggccgggcatggtggctcatgcctgtaattctagcactttgggaggccaaggcaggtggattgcctgagctcaggagttcgagaccaccctgggcaacatggtgaaaccctgtctctcctaaaaaaaaaaaaaaaaattacaaaaaatttgccgggcatggtggtgcacacctgtagtcccagccactctaaaggctgaggtacaagaattgcttgagcccagggtcagaggttgcagtgagtggagatcgcgccgctgcgctgcagcctgcgcgacagagcgagactatgtttttttttaaaaaa

SEQ ID NO: 45379 - DNA, 2158 bp, Homo sapiens
tgtggttgagtcttcacgaacttcttgtcatcaggcaatagttgattccccttttttgaaagctttcaatttcatttatccttagtgttgaaaagtgtcagaaaattgaaatggacacagatgattgtatctgccctccctttcaggaaagccatgttgactttaaaatatcaaaaaagaaagttcagttatgattgcagggggtaatgatagtttgatccacaaactatttgcagtgtaaaagtgaaataccttagctgacttagttcatttttgaaagttttgaatagctaaaacaaagttggcaaataggctcatagagtagttacagagtaagactaaattcatatttgatgcagattcctctctacctcccattctgggaggatttagttttactgtttggtgtttaggataatgattgttctgtttttctcaccctactatgtgaatatatattctgttagagatgggctgttatctgcaatgtggactcaataccatgggcttgagtttggttagttcatcattagagattttttttcagcagttggtttactttatgagaaaggatcatgagtttaattttcccactgatatatttgtgttctcattgctgagatataagtttcttaatgatttgttacctttttctattttcctagactagtattacttactggtattagcacacacacatcacatgcagaaatggtgttttcttgccacttactctttctcataagatgcttatattcctgtgggcatttgtcttccacactacagcacataatttgatgaaactgattttctgtgcaagagcttgtgtttctccaactctggttttatggaccacttttcattggtatataggaggcggttaaaacgtggtggtagaatgcaggttttaggttagctggggtgtgaagaatcccaggtctttgggatagtctttggcaagttactcaactcctctaagttagtttcttgatctgtcagatgacagtaaacctcagagtgtgaaaattaaatggatataatgtgtgtaaagcacttagcataatgctttatacatcgtaaaactttcaaaaataggagtagtaattattacaaagaaatgtgaagaagagtcctagtgggctgcatgttaaaaatagtttttagttaatgaaaattaaatcacatcttagatgtttatcatctgcatggtacttttctggttgctgctttaacctttgtatagttgaaagtctgtaaactttctagtattctttgatttctggcccatttccctcctaccattcacgcttatattttttggttcaagtcaccattccttgcaaaactaattaaatacattcctaaatacataatattgccaatattcattcacatccaccacgtctagatccaagtcttcatcttctttatgctggtctaatttttgctgagccttagaagcaaagacagactccgggggttgatatgggacctccagaatggggattgcacagaataatcttatttttcctctattcttctagtctgttatgttctgaacccacacatgttttcggaaggaccagatggctgacactggctaatgggaaccaaaagacgagtgaaagtaacctggttgtcacatacccccagcttagaggtgcttcaccctgccccaaggtcaatttcttttttctctagagactttaccccattatatcaaaaacctttactacagcctgactttatctgatgttagagtatcattaagtcaagcagcagcatttattgagtgaaaaaagattgtacacaggactggaagagaagcatctgcctttaaaatacagtagaaggccgggcatggtggctcatgcctgtaattctagcactttgggaggccaaggcaggtggattgcctgagctcaggagttcgagaccaccctgggcaacatggtgaaaccctgtctctcctaaaaaaaaaaaaaaaaattacaaaaaatttgccgggcatggtggtgcacacctgtagtcccagccactctaaaggctgaggtacaagaattgcttgagcccagggtcagaggttgcagtgagtggagatcgcgccgctgcgctgcagcctgcgcgacagagcgagactatgtttttttttaaaaaa

SEQ ID NO: 45380 - DNA, 2158 bp, Homo sapiens
tgtggttgagtcttcacgaacttcttgtcatcaggcaatagttgattccccttttttgaaagctttcaatttcatttatccttagtgttgaaaagtgtcagaaaattgaaatggacacagatgattgtatctgccctccctttcaggaaagccatgttgactttaaaatatcaaaaaagaaagttcagttatgattgcagggggtaatgatagtttgatccacaaactatttgcagtgtaaaagtgaaataccttagctgacttagttcatttttgaaagttttgaatagctaaaacaaagttggcaaataggctcatagagtagttacagagtaagactaaattcatatttgatgcagattcctctctacctcccattctgggaggatttagttttactgtttggtgtttaggataatgattgttctgtttttctcaccctactatgtgaatatatattctgttagagatgggctgttatctgcaatgtggactcaataccatgggcttgagtttggttagttcatcattagagattttttttcagcagttggtttactttatgagaaaggatcatgagtttaattttcccactgatatatttgtgttctcattgctgagatataagtttcttaatgatttgttacctttttctattttcctagactagtattaaaattttgatggcatatgggtttggttccacttgtagagaataaatgttcacaacttactggtattagcacacacacatcacatgcagaaatggtgttttcttgccacttactctttctcataagatgcttatattcctgtgggcatttgtcttccacactacagcacataatttgatgaaactgattttctgtgcaagagcttgtgtttctccaactctggttttatggaccacttttcattggtatataggaggcggttaaaacgtggtggtagaatgcaggttttaggttagctggggtgtgaagaatcccaggtctttgggatagtctttggcaagttactcaactcctctaagttagtttcttgatctgtcagatgacagtaaacctcagagtgtgaaaattaaatggatataatgtgtgtaaagcacttagcataatgctttatacatcgtaaaactttcaaaaataggagtagtaattattacaaagaaatgtgaagaagagtcctagtgggctgcatgttaaaaatagtttttagttaatgaaaattaaatcacatcttagatgtttatcatctgcatggtacttttctggttgctgctttaacctttgtatagttgaaagtctgtaaactttctagtattctttgatttctggcccatttccctcctaccattcacgcttatattttttggttcaagtcaccattccttgcaaaactaattaaatacattcctaaatacataatattgccaatattcattcacatccaccacgtctagatccaagtcttcatcttctttatgctggtctaatttttgctgagccttagaagcaaagacagactccgggggttgatatgggacctccagaatggggattgcacagaataatcttatttttcctctattcttctagtctgttatgttctgaacccacacatgttttcggaaggaccagatggctgacactggctaatgggaaccaaacctgccccaaggtcaatttcttttttctctagagactttaccccattatatcaaaaacctttactacagcctgactttatctgatgttagagtatcattaagtcaagcagcagcatttattgagtgaaaaaagattgtacacaggactggaagagaagcatctgcctttaaaatacagtagaaggccgggcatggtggctcatgcctgtaattctagcactttgggaggccaaggcaggtggattgcctgagctcaggagttcgagaccaccctgggcaacatggtgaaaccctgtctctcctaaaaaaaaaaaaaaaaattacaaaaaatttgccgggcatggtggtgcacacctgtagtcccagccactctaaaggctgaggtacaagaattgcttgagcccagggtcagaggttgcagtgagtggagatcgcgccgctgcgctgcagcctgcgcgacagagcgagactatgtttttttttaaaaaa

SEQ ID NO: 45381 - DNA, 1648 bp, Homo sapiens
tgtggttgagtcttcacgaacttcttgtcatcaggcaatagttgattccccttttttgaaagctttcaatttcatttatccttagtgttgaaaagtgtcagaaaattgaaatggacacagatgattgtatctgccctccctttcaggaaagccatgttgactttaaaatatcaaaaaagaaagttcagttatgattgcagggggtaatgatagtttgatccacaaactatttgcagtgtaaaagtgaaataccttagctgacttagttcatttttgaaagttttgaatagctaaaacaaagttggcaaataggctcatagagtagttacagagtaagactaaattcatatttgatgcagattcctctctacctcccattctgggaggatttagttttactgtttggtgtttaggataatgattgttctgtttttctcaccctactatgtgaatatatattctgttagagatgggctgttatctgcaatgtggactcaataccatgggcttgagtttggttagttcatcattagagattttttttcagcagttggtttactttatgagaaaggatcatgagtttaattttcccactgatatatttgtgttctcattgctgagatataagtttcttaatgatttgttacctttttctattttcctagactagtattaaaattttgatggcatatgggtttggttccacttgtagagaataaatgttcacaacttactggtattagcacacacacatcacatgcagaaatggtgttttcttgccacttactctttctcataagatgcttatattcctgtgggcatttgtcttccacactacagcacataatttgatgaaactgattttctgtgcaagagcttgtgtttctccaactctggttttatggaccacttttcattggtatataggaggcggttaaaacgtggtggtagaatgcaggttttaggttagctggggtgtgaagaatcccaggtctttgggatagtctttggcaagttactcaactcctctaagttagtttcttgatctgtcagatgacagtaaacctcagagtgtgaaaattaaatggatataatgtgtgtaaagcacttagcataatgctttatacatcgtaaaactttcaaaaataggagtagtaattattacaaagaaatgtgaagaagagtcctagtgggctgcatgttaaaaatagtttttagttaatgaaaattaaatcacatcttagatgtttatcatctgcatggtacttttctggttgctgctttaacctttgtatagttgaaagtctgtaaactttctagtattctttgatttctggcccatttccctcctaccattcacgcttatattttttggttcaagtcaccattccttgcaaaactaattaaatacattcctaaatacataatattgccaatattcattcacactacgcacactccgctgacactttataatgtaagcttgccctgggactttgggtcagcccgctgctattcgtctggaggattgatatttattttgcattgcgatggctgaagcatttatttaacgatctttttacctggatatgtctgtgaggctcctgaaaggagacaaataaagtcaatatatttgcaaaaaaaaaaa

SEQ ID NO: 45382 - DNA, 374 bp, Homo sapiens
tactcacctaccataactgattgatagaaacatagatctccaattgactttagtttctgctccacagatctgttatgaatctcactgagaatctaagatacagttgtaaagtatagttgaagagttttggtttctatgtatagtccaactaagcacctcagagcactgattgccaattgcaatcctctaagttgtgttgagaaaagaaaaataagttatttcaccttcagtttccatgaaataggatgaagttactataatcaggtaaggtgacacttaaaatattaaaacttttgtaaagaaaggcaaaattatgatgtgatatgtgctatagacatagctgaacatgactgtttttaaaccaaattctggta

SEQ ID NO: 45383 - DNA, 439 bp, Homo sapiens
gcatttattttatcaaacaactcaggtagaagctatgccaatttgacaatttttggaaacctaacctaatattctcttcctatctctatgaaataccaagagaaacctatcggagtttggtaatttcatgaaatgtatccatgattggggtaggagtgacatttacatgctcttctttattgttggcagtaaaaataagtcttttgtaagcagtgtatatcagaatgtataaggtacaagtgttttacctggaaatgatgggataggaaattatgattatgatgttaaaactgtgaaaagtagaaaaccacatggatgatatcaccccattttaaaatggaataagtattcaacaagaatttgtgtgaaatgcatttattcctataacataagaccaataaaatgagggaaccagacatacagtaaaaggagaaaaaca

SEQ ID NO: 45384 - DNA, 640 bp, Homo sapiens
caaacccctaccccctgtaatttggtctacaatatttaagacagagagaaaagtaacgggttgatgtttgactctctcagcattttgagtctggcttcccaattcctgacttgactttttgtctcatttgaggtcccaattctaagccaccaaaccacctgactaaagaaacttttttcttcagagtgctcccacctccctggcttcatcctcaaataggtcatcagtagcagtccacagtcaacagcaatggctgcacgaccttccccatccttgtgtagcagccccccaagtcctctgctaaagggcaaagcaaagtgagaaacagttaccctggcaatcagatgccagataactgccccgattctgctcgtccttggtggcattttcctgcttcccctactctaaatgggcaccctgaattaggggcaccagcttccttcaatgcctttaatataggtgactgtcaccgaatacaggcttaaatatttcagtgggggattcaggctgtagttcaaagaggttaaatgatcatttttaaaacaataggaagtggcaacataatttttcaaaaccaagaataaccagtcctatgttgtgttccccctttgcggatatgatttttcagtgatttaattaa

SEQ ID NO: 45385 - DNA, 1905 bp, Homo sapiens
  misc_feature (1529)..(1529): n is a, c, g, or t
  misc_feature (1532)..(1532): n is a, c, g, or t
  misc_feature (1534)..(1535): n is a, c, g, or t
  misc_feature (1550)..(1550): n is a, c, g, or t
  misc_feature (1564)..(1565): n is a, c, g, or t
  misc_feature (1570)..(1570): n is a, c, g, or t
gaatgtgaatattccagagatttatgctcaaagtccccaggttagtgtctttctttctcactagactgtaagcttcttgaagacaaatatcttgagtgttaccttgctcactcttgaattgtcaaaacttggcccaggactaggtatgtggtatacaatcaataaaaatttgttgaatgaatgttcttcaaaatccttccatggcaaaaacagaagaaacattcacgagtggactgctagttgactgtttctctcatcgctattgacagtctgaaatggacaaagacatctatataatcattccttcctttcaaataaataatctgtgaattacgctattcttttcctattgcttcaggacaagctatttgacagaaagcttttaagaaaggctttgcaagaaaactctgcaacagagatggcacgtatgaattgctgtgatctggagttgaagacaagaacaaaagtaactctagagcagaattctttgaccaaagtcatcttactggttggcggaggctctcagtctacttgcatccggtgcttgagagttcagacaggcaaagatgagaggtagcatctagtcaacatccatttcttgagcacttactacatgtcagccactttgcttagtccccggttttactgtgctctgctaggaagtggtgaagagattcggcgggatcttcttaggaccaatcctacaaagttccagatggaactcattttgatttgggggacggtttacttgcagggattaggtggagaaacagggcctgctactcaagaggaatgagaaactgtaactaacaggaggtagactgggaaggagcatggcaaagtcaccccttttcacagggcaacgctccaaagaccacgctcaagctggggtggcagggctctgaacatggggccccgacccgggcctcggcctggggccacgtgacgcgcgtgtttacgttgagtgacgggcgctgtgttgggcgggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcagctcgatcaagtcatccgccaaagaagcctgtccagtttggaactgttcctctcctgtgcacagaaacaaccacggttgaccacaggtaactgaaaccacaggaatgagatgacagggatactgaggggctacttgtgagatggcaaaaaagagatatggcaaccagaatttccctcagtcgcccctgacaagttctcctacatcttcacacaaagagaagtctggcctaggaggtggaggatgcagcgcaccaagatcgcaccactgtactccaggatgggcaccagagtgagaccttgtctcaaaaaaaaaaaaaaaaaaaaaaaantgngnncccaagttgtggaanaatgggcgcctgtnntgaanaggtgtttgaaggatatagggttctgtacaaagtgggaaacactaaaaaaagggagaataggaagaacgactactacaacgattggtaaactgcacgcaatcgagtcttacatataaacaagaaaaatcggggatatgtttgaagaaaatgaagtgttgttaaacaacctcccttttcccagattgtatgcaacgatggggacaacccaattcctcattgggcacgaggtgatggacacaaacatctagtggtatcacatcacaatttgaggcacactacggtggaacatgtaattgtggacaaggaacttgcctaaaaacaaagcccataagaa

SEQ ID NO: 45386 - DNA, 1308 bp, Homo sapiens
gaatgtgaatattccagagatttatgctcaaagtccccaggttagtgtctttctttctcactagactgtaagcttcttgaagacaaatatcttgagtgttaccttgctcactcttgaattgtcaaaacttggcccaggactaggtatgtggtatacaatcaataaaaatttgttgaatgaatgttcttcaaaatccttccatggcaaaaacagaagaaacattcacgagtggactgctagttgactgtttctctcatcgctattgacagtctgaaatggacaaagacatctatataatcattccttcctttcaaataaataatctgtgaattacgctattcttttcctattgcttcaggacaagctatttgacagaaagcttttaagaaaggctttgcaagaaaactctgcaacagagatggcacgtatgaattgctgtgatctggagttgaagacaagaacaaaagtaactctagagcagaattctttgaccaaagtcatcttactggttggcggaggctctcagtctacttgcatccggtgcttgagagttcagacaggcaaagatgagaggtagcatctagtcaacatccatttcttgagcacttactacatgtcagccactttgcttagtccccggttttactgtgctctgctaggaagtggtgaagagattcggcgggatcttcttaggaccaatcctacaaagttccagatggaactcattttgatttgggggacggtttacttgcagggattaggtggagaaacagggcctgctactcaagaggaatgagaaactgtaactaacaggaggtagactgggaaggagcatggcaaagtcaccccttttcacagggcaacgctccaaagaccacgctcaagctggggtggcagggctctgaacatggggccccgacccgggcctcggcctggggccacgtgacgcgcgtgtttacgttgagtgacgggcgctgtgttgggcgggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtaagtgaacgctcgccttccggggcctgggtcttggggtcggggccgcgcgaggcgagcggagagcgccccaccgggggaggagcgcggacgagcttccgccgcct

SEQ ID NO: 45387 - DNA, 2479 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45388 - DNA, 3534 bp, Homo sapiens
gaatgtgaatattccagagatttatgctcaaagtccccaggttagtgtctttctttctcactagactgtaagcttcttgaagacaaatatcttgagtgttaccttgctcactcttgaattgtcaaaacttggcccaggactaggtatgtggtatacaatcaataaaaatttgttgaatgaatgttcttcaaaatccttccatggcaaaaacagaagaaacattcacgagtggactgctagttgactgtttctctcatcgctattgacagtctgaaatggacaaagacatctatataatcattccttcctttcaaataaataatctgtgaattacgctattcttttcctattgcttcaggacaagctatttgacagaaagcttttaagaaaggctttgcaagaaaactctgcaacagagatggcacgtatgaattgctgtgatctggagttgaagacaagaacaaaagtaactctagagcagaattctttgaccaaagtcatcttactggttggcggaggctctcagtctacttgcatccggtgcttgagagttcagacaggcaaagatgagaggtagcatctagtcaacatccatttcttgagcacttactacatgtcagccactttgcttagtccccggttttactgtgctctgctaggaagtggtgaagagattcggcgggatcttcttaggaccaatcctacaaagttccagatggaactcattttgatttgggggacggtttacttgcagggattaggtggagaaacagggcctgctactcaagaggaatgagaaactgtaactaacaggaggtagactgggaaggagcatggcaaagtcaccccttttcacagggcaacgctccaaagaccacgctcaagctggggtggcagggctctgaacatggggccccgacccgggcctcggcctggggccacgtgacgcgcgtgtttacgttgagtgacgggcgctgtgttgggcgggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45389 - DNA, 2416 bp, Homo sapiens
ttcttgttcgttagaatgagggctccattattttggccacagagctatatccaggactgcttcagagcaagccccgtgtctgaatcttcagagggtagaagtcatcatcctgtttactcaggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45390 - DNA, 3384 bp, Homo sapiens
gaatgtgaatattccagagatttatgctcaaagtccccaggttagtgtctttctttctcactagactgtaagcttcttgaagacaaatatcttgagtgttaccttgctcactcttgaattgtcaaaacttggcccaggactaggtatgtggtatacaatcaataaaaatttgttgaatgaatgttcttcaaaatccttccatggcaaaaacagaagaaacattcacgagtggactgctagttgactgtttctctcatcgctattgacagtctgaaatggacaaagacatctatataatcattccttcctttcaaataaataatctgtgaattacgctattcttttcctattgcttcaggacaagctatttgacagaaagcttttaagaaaggctttgcaagaaaactctgcaacagagatggcacgtatgaattgctgtgatctggagttgaagacaagaacaaaagtaactctagagcagaattctttgaccaaagtcatcttactggttggcggaggctctcagtctacttgcatccggtgcttgagagttcagacaggcaaagatgagaggtagcatctagtcaacatccatttcttgagcacttactacatgtcagccactttgcttagtccccggttttactgtgctctgctaggaagtggtgaagagattcggcgggatcttcttaggaccaatcctacaaagttccagatggaactcattttgatttgggggacggtttacttgcagggattaggtggagaaacagggcctgctactcaagaggaatgagaaactgtaactaacaggaggtagactgggaaggagcatggcaaagtcaccccttttcacagggcaacgctccaaagaccacgctcaagctggggtggcagggctctgaacatggggccccgacccgggcctcggcctggggccacgtgacgcgcgtgtttacgttgagtgacgggcgctgtgttgggcgggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcagtatctggagtccatctttcaccatcttctcctgagattgtactggaccgtgaccactcttcttccattggctgcctctcttctgatgccattatttcatcaccagagaatacacatgcagcaaatagcattattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45391 - DNA, 2452 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45392 - DNA, 1902 bp, Homo sapiens
catacagtagcattttccttttttaattttagaaagtagtttttcataaaatatattatttgttaatatcatgcaattatattaattttaaatgaattaataattttattttttcttgaatttctaatatgtattaatacatatgatcaacataaacaaaatctctttgatatcctcaataattttaagattgtaaagggatctttagaccatatagtttgaaatctgctactccaccctaaggcctgatttctttgaagattagaaatgccatggaaattaagtaggaatatttgtataaaaaagaataatagattttattttgtagcagttatttactatgcataaaaacagcaatgttagaactaaacactataggatcaaagttttttatcttttaggttaaccaagtctgttactcaagaaattattatgcagtctttcaaatttgttctggtctttatttattttgctttttcaagcttcaaaataaataaagaccagacacttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45393 - DNA, 1177 bp, Homo sapiens
cacaccaacccacccgcatagtagtacgcaacttaaaaaaatacagactaacatgctactacgaaccaagtacctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45394 - DNA, 2510 bp, Homo sapiens
  misc_feature (2018)..(2018): n is a, c, g, or t
  misc_feature (2414)..(2414): n is a, c, g, or t
  misc_feature (2480)..(2480): n is a, c, g, or t
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattatcagttaacttatgaccggggggagtcatcaataatcattctgcgcagtgccacattttggcgcgagagaccgggagagtggaagtggccacatttcttcggagaacaggggaccacatagcatggaaacagctgagaaccgaccctggcgtcttctcccacacacctcctctttgccttcatctctcgccctctctacaaacaacagagacaaacacaacaaaaagaaaaaaaaaaagaaaaaaaganatgcctatgggtgaagctagactatattaattatatagtatggcacataatatgtcaaaaatgcaatattgctaaaaatgcaatattgctacataataaaagtgtgtataagataattgaattcttagaatatcaatcacaaattgatgtatttgttattttgtttatatctaatggccttataaatgtctttcttcagggaaacatgcaattttcattgtgagctgccttccagagtttatggtagaacttcactgacgttgctgatgccaatgtggaataaaggtctttatagtttagaaagttaaaatgtataaatgggctgcaccaaaaagtgactcactttccttaaattttaaaatacataatacaaacttatttgaatttttagaaagnacactggaaaatcaagtaatatatgtacgacatgtttatcttgctatatccgtacttttgtcctangtcatacttgatatatggattccattcggg

SEQ ID NO: 45395 - DNA, 2110 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacaaccacggttgaccacaggtaactgaaaccacaggaatgagatgacagggatactgaggggctacttgtgagatggcaaaaaagagatatggcaaccagaatttccctcagtcgcccctgacaagttctcctacatcttcacacaaagtaagagggccgccacttcacggtgatctcagcactcctaatgccatttggaaaattctggacttggattaagcactactcaggcaggacagttcacagatatctgtgagccatgacttaaggcccatcatctctgaagctatttccaagttagttagcatcatatggacaaacagagggagaggcagaaagagaaatttcttttcctgcaacgtatgtgttatgttaacaataggatacaatgaagttagggaatcatgtatgaatgtaaatgcccctgcatccccaccgtgttcagtactttatgtattacctttgtcttttccatgatatgcttcttacacattcccccactctttccatggttatctgtcaattgtcaaatgctgtttacctagagcatcggggttctcatttgctagacttttttttttttgcagtttattattctttacctctgtttactaaactccagcatctcacctacattatgtaactttttatcaaggtaagtgaaatgt

SEQ ID NO: 45396 - DNA, 1966 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacaggatactgaggggctacttgtgagatggcaaaaaagagatatggcaaccagaatttccctcagtcgcccctgacaagttctcctacatcttcacacaaagagaagtctggcctaggaggtggaggatgcagcgcaccaagatcgcaccactgtactccaggatgggcaccagagtgagaccttgtctcaaaaaaaaaaaaaaaaaaaaaatggtccccagtgtgggagatggggcctggtggaaggtgtgtgggtcgggtcatgagagtggatccttcatgaggtgcttggtgcagtcttcactgtaatgagtcagttcatacaagatctggttgtttagaagagtgtgacacccttcccatctctctcttgctccctctcttgccacgtggcacatctgctcctcctttgccttctgccatgattggaagcttcctaaaaccctcaccagaagcagatgccagcaccatgcttcttgtagagcctgcagaaccataagccaaataaacctcttttctttata

SEQ ID NO: 45397 - DNA, 2013 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacaaccacggttgaccacaggtaactgaaaccacaggaatgagatgacagggatactgaggggctacttgtgagatggcaaaaaagagatatggcaaccagaatttccctcagtcgcccctgacaagttctcctacatcttcacacaaagagaagtctggcctaggaggtggaggatgcagcgcaccaagatcgcaccactgtactccaggatgggcaccagagtgagaccttgtctcaaaaaaaaaaaaaaaaaaaaaatggtccccagtgtgggagatggggcctggtggaaggtgtgtgggtcgggtcatgagagtggatccttcatgaggtgcttggtgcagtcttcactgtaatgagtcagttcatacaagatctggttgtttagaagagtgtgacacccttcccatctctctcttgctccctctcttgccacgtggcacatctgctcctcctttgccttctgccatgattggaagcttcctaaaaccctcaccagaagcagatgccagcaccatgcttcttgtagagcctgcagaaccataagccaaataaacctcttttctttata

SEQ ID NO: 45398 - DNA, 1447 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaagggtaagtatctcctgaaaagttttaatttgtgcttcaataaactgaatcagtgacttccatacaaaaaaaaga

SEQ ID NO: 45399 - DNA, 1841 bp, Homo sapiens
gaatgtgaatattccagagatttatgctcaaagtccccaggttagtgtctttctttctcactagactgtaagcttcttgaagacaaatatcttgagtgttaccttgctcactcttgaattgtcaaaacttggcccaggactaggtatgtggtatacaatcaataaaaatttgttgaatgaatgttcttcaaaatccttccatggcaaaaacagaagaaacattcacgagtggactgctagttgactgtttctctcatcgctattgacagtctgaaatggacaaagacatctatataatcattccttcctttcaaataaataatctgtgaattacgctattcttttcctattgcttcaggacaagctatttgacagaaagcttttaagaaaggctttgcaagaaaactctgcaacagagatggcacgtatgaattgctgtgatctggagttgaagacaagaacaaaagtaactctagagcagaattctttgaccaaagtcatcttactggttggcggaggctctcagtctacttgcatccggtgcttgagagttcagacaggcaaagatgagaggtagcatctagtcaacatccatttcttgagcacttactacatgtcagccactttgcttagtccccggttttactgtgctctgctaggaagtggtgaagagattcggcgggatcttcttaggaccaatcctacaaagttccagatggaactcattttgatttgggggacggtttacttgcagggattaggtggagaaacagggcctgctactcaagaggaatgagaaactgtaactaacaggaggtagactgggaaggagcatggcaaagtcaccccttttcacagggcaacgctccaaagaccacgctcaagctggggtggcagggctctgaacatggggccccgacccgggcctcggcctggggccacgtgacgcgcgtgtttacgttgagtgacgggcgctgtgttgggcgggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagggttttggggaagcaaaccgggaacttacccggggtgggcctcttggtggaaagctaaggcttagggcttctaaagaaagagcagagcattctttcagatagtccagacttcgaaacttacggatgtggctgtgaagggtccacccgcttgggggatatggcctgggtccctaaacaagcgttggct

SEQ ID NO: 45400 - DNA, 3411 bp, Homo sapiens
gaatgtgaatattccagagatttatgctcaaagtccccaggttagtgtctttctttctcactagactgtaagcttcttgaagacaaatatcttgagtgttaccttgctcactcttgaattgtcaaaacttggcccaggactaggtatgtggtatacaatcaataaaaatttgttgaatgaatgttcttcaaaatccttccatggcaaaaacagaagaaacattcacgagtggactgctagttgactgtttctctcatcgctattgacagtctgaaatggacaaagacatctatataatcattccttcctttcaaataaataatctgtgaattacgctattcttttcctattgcttcaggacaagctatttgacagaaagcttttaagaaaggctttgcaagaaaactctgcaacagagatggcacgtatgaattgctgtgatctggagttgaagacaagaacaaaagtaactctagagcagaattctttgaccaaagtcatcttactggttggcggaggctctcagtctacttgcatccggtgcttgagagttcagacaggcaaagatgagaggtagcatctagtcaacatccatttcttgagcacttactacatgtcagccactttgcttagtccccggttttactgtgctctgctaggaagtggtgaagagattcggcgggatcttcttaggaccaatcctacaaagttccagatggaactcattttgatttgggggacggtttacttgcagggattaggtggagaaacagggcctgctactcaagaggaatgagaaactgtaactaacaggaggtagactgggaaggagcatggcaaagtcaccccttttcacagggcaacgctccaaagaccacgctcaagctggggtggcagggctctgaacatggggccccgacccgggcctcggcctggggccacgtgacgcgcgtgtttacgttgagtgacgggcgctgtgttgggcgggccttggcggaaatcaacttccgggggcagaggtgttcgaagccgggtggtgcgtgggctaccccaacctgtgtggctgggccgcggtctcccctcaagggcctggggccgtgcctcgggtgtacgcgtaggggtctgtgtgctgggggtggctcaccgggcagcgtgggtgagcggcgcagcggcggcagcggagagcgagagaggggagcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45401 - DNA, 2750 bp, Homo sapiens
ggaagaacctttgtggtaggggacagatttccaaaaactcaccacagtcctgttcttagctggagtttgtgctgatgttgccagacaactgaggaatagatgcaaaaagcaggaagcattattgaattgagctctagtgccaatttgggaaaagcaaattaaaatgtaaaagaatatttttccactcctggcatctcaacataaaatggcaaaatacatggttgctgaaaaagttacagaaattgctaattttgccaaaaagtaaaagccaattgcaaattcttttttgcataaaaaatgcatagacagttagaaattctaatttacaaataaatatgtatacatttaagttggagagtattttgacataaatgactgtgtgtgtgcgggcttgtttcaatatcttatatttttcaggtgccacttgaagaatggatgatgatgattttggtggttttgaggctgcggagacttttgatggtggaagtggtgaaacccaaacaacatctcctgctattccttgggctgcctttcctgcagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45402 - DNA, 1863 bp, Homo sapiens
cagacagaagttaagtaagaggctttgggtcaagactgtgactggattcaaatcctaaagttttcgctacactgtgtgctgtggttcctccttcacaggctcatgctctctctctcacctgccgccatgtaagatgtgcctgcttctccttctgccatgattgtaagtttcctgaggcctccccagccgtgcaaacctgcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattataaagatgtgtttgttttctttccaaatcatgtagaattgatttccagttcaaggataaaccaaaacaatatttagaactatcaagtgatctaatttattttcttttggtttcttctttacatttactgttattttattattattagtagtagcagcaacagagtatgatatgacccaaaagccattgtaaagtgccacattaccaaaattaattaagtaaactttatagcctgtgggagtctattatatattattttgcaaaagtagtaaatatattattgtttcatgatgactcttgatgagatgctagaatgtaaccatacatttatcttattttgaggatagaaatagcatggatttcaacatcacttatttatctgtataattggaaataaaacaccgatatgatagagaatcattccggcattacctaacctcttctgcagttggatctatgtattttcattggtctactgaaaacaaacaatacaattaaaagcactaaagattattatattaattcaactttgatctgatatatcacttaaactaaaggggtgtgtgtggtgtatgcttgtttcctatttctgctctttaaagatactttgaatcaataaaaccattagtctacaaatcaaattgtgaacttaatctctagaaagagaatataactcagccatttataggaatttaggttcaagtacaggatatatgaaatcttttcccagtatttcagaatgtacttaattcacaggcaggatgcttcaatgcaaaatcatgaatatttttaattcaaaactaaaatgtcattaatatgtatgtatgcaaatgttttatcttattttctgaaatgcatctactttcatgggctttgtacgtttctgagatttctcagtgtaataaaaagagctcccaaactta

SEQ ID NO: 45403 - DNA, 1559 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagttaagtgctttaatagctacggaaccagttgacattgaataaaaagaacatgacaaacccacactggcattggataaatcatattacaccttcaaaatacacactctgaattata

SEQ ID NO: 45404 - DNA, 1867 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacagagaagtctggcctaggaggtggaggatgcagcgcaccaagatcgcaccactgtactccaggatgggcaccagagtgagaccttgtctcaaaaaaaaaaaaaaaaaaaaaatggtccccagtgtgggagatggggcctggtggaaggtgtgtgggtcgggtcatgagagtggatccttcatgaggtgcttggtgcagtcttcactgtaatgagtcagttcatacaagatctggttgtttagaagagtgtgacacccttcccatctctctcttgctccctctcttgccacgtggcacatctgctcctcctttgccttctgccatgattggaagcttcctaaaaccctcaccagaagcagatgccagcaccatgcttcttgtagagcctgcagaaccataagccaaataaacctcttttctttata

SEQ ID NO: 45405 - DNA, 1914 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaagtgaaaaggctgtggaagaggcagtgaaaagaacaagagatgaattgatagagtatataaaagaacagaaaaggctcgatcaagtcatccgccaaagaagcctgtccagtttggaactgttcctctcctgtgcacagaaacaaccacggttgaccacaggtaactgaaaccacaggaatgagatgacaggagaagtctggcctaggaggtggaggatgcagcgcaccaagatcgcaccactgtactccaggatgggcaccagagtgagaccttgtctcaaaaaaaaaaaaaaaaaaaaaatggtccccagtgtgggagatggggcctggtggaaggtgtgtgggtcgggtcatgagagtggatccttcatgaggtgcttggtgcagtcttcactgtaatgagtcagttcatacaagatctggttgtttagaagagtgtgacacccttcccatctctctcttgctccctctcttgccacgtggcacatctgctcctcctttgccttctgccatgattggaagcttcctaaaaccctcaccagaagcagatgccagcaccatgcttcttgtagagcctgcagaaccataagccaaataaacctcttttctttata

SEQ ID NO: 45406 - DNA, 1501 bp, Homo sapiens
agcggagtatggtgtgactggagtgaagttagcacttagtggtatcatttctggcttgagcaaatggttttttgatgtattattaactgagatggaaaacatgaagcaaagcaggtttatttaagatgatgggcaagcttggtatacctgttggacaactgaatgaaactatctggtagtaagggaaacatgcaattttcattgtgagctgccttccagagtttatggtagaacttcactgacgttgctgatgccaatgtggaataaagtatctggagtccatctttcaccatcttctcctgagattgtactggaccgtgaccactcttcttccattggctgcctctcttctgatgccattatttcatcaccagagaatacacatgcagcaaatagcattgtgagtcaaactattccaaaagcacagattcagcaatcaacacacactcatctggatatctcactttttccattgggtttaactgatgaaaaaagtaatggaacaattgcccttgtggatgattctgaggatcctggagccaatgtatctaacatacagcttcagcaaaaaatttcaagtctggagattaaactcaaagtatctgaagaagaaaaacagagaattaaacaggatgtggaatcattgatggaaaagcataatgtcttagaaaaaggctttctaaaagaaaaagagcaagaggccatttcttttcaagatagatacaaagaacttcaggaaaaacataaacaagaattggaagacatgaggaaagctggtcacgaagccctcagcattattgtggatgaatataaggcactactgcagtcttcagttaagcaacaagtagaagctattgaaaaacagtacatttctgcaattgagaaacaggcacacaagtgtgaggagttgctaaatgctcagcatcagaggctccttgaaatgctagatacagagaaggaactgttaaaagaaaaaataaaggaagctttgattcagcaatctcaagaacagaaggaaatattggaaaagtgtttggaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatacaagaacaaagaaaaataagtcaggaaactgttaaggcagcaataatagaagagcagaaacgaaggaagaaaggcaaagaaataaagaggcattagtatccgctgcaaagcttgaaaaagaagcaatgaaggatgcagttttaaaagtcgtagaagaagaaagaaaaaatttagaaaaagcgcatgctgaagaaagggaattatggaagacagaacatgcaaaagatcaagaaaaagtatctcaggaaattcaaaaagctatac

SEQ ID NO: 45407 - DNA, 418 bp, Homo sapiens
aatcatgtgaacccagaaggcagaggctgaagtgagccaagatcacgccactgcactccagcccgggtgacagtgcaagactctgtctcaaaaaaaaaaaaaaggttgcctagtgctgggggatatgaggaggttgggggatgacggctcaggagtatagggtatctttttgaggtaataacaatgttctaaaactgcctgtggtgatggttgcaaaactctgtgaatataccaacagccactgaattttaaagtttaaataaataaatcgtattacatgtgagttatatatctcagtaaagctgtttttaaaaaagtctagaagaggaagactgactcgggagcctctctctctctgcaggagagaaagctattctcttttctctttctttcgcctgttaaaccttggctcttaact

SEQ ID NO: 45408 - DNA, 3339 bp, Homo sapiens
gatttttattaagcagtcttagcccaaaggcagcatccttccttgctagagagaaagggcactttggtccctggaaagacagaggcaagcagcagcatcggagacactgctcccagtcaggactcaaagtcagcgacagaagtgtttctgagtggattaggaaaggtaacctcatcgtttatatgcacttgtctggtcaggcaatattttgactttgctggcagagattctgtccaaacacctgctcttcttcatacatcttctagaggtgctggccagacatggctccaggtcactggaaatgagctgctgcatgttgagtatctgcagtcctgtagcaagggcagacttggcactcatgggctgatgttgccgcagctgcccctgctcccacaccacaggttacatgatcccttgtcctgtccatggtctttggcagggtcacagggcagagggaagggtcagagagaagtgacatcttgaagggctggtgcctgggtaagaaaggttgcccatctggcatcccatttcaattgggttttctgcttgttaaatgaggcccctaagtcctaacctgccaatcacaggagctaaggcaaggttccgctttggggaaatctaccttttaagagacttcttgttcagaagtcttcaggaaatgaggctctgatggtagaatgccataaactgtgttaactgatgaaggggaaagtttagttgggaagtgaggagaaccacccaatgctttaaccatgaagccagctcagccaaagtgctgggcagtcgtgggcttttctatgctttgtttccccattagtagcctttgaaaatctatgcaattgaggggaagtaaaggcaggaaggactacctacccaggcagagcagtcttgccatccccaaacacctgtggtctccaggagtctccttgataggagagccccctggtaggggcacttgctttagctttcacaatttattaggaaatggggctcaggatgggtgggcaactgtggtgaggcagggggagatgaaaacaggcatgttccattgatgagctcatattatcagtgggctcaaccatccatcatcagtgttgctcttccaaacagcactgtgcccacctggcagcaaagcgacttttggtttcaaaataattgagcacaggattttatggaatgtgcttaggggtcagttatgagttgtctcccagatgggtgagatcctgagaattttcaggctaatggagagtcctcatcctgtctgagcaatttcccctcagaattggttatcttcaatatactggactgtgctgtttctacacatcccagtgggtgggtttagaagatgactatttgccccctaaatgtggtcaatgggatagcaggaagacaaagaatgccatcctcagccccaaatataattcctgggttctgactcacaggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaactactt

SEQ ID NO: 45409 - DNA, 1957 bp, Homo sapiens
gcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaactactt

SEQ ID NO: 45410 - DNA, 1161 bp, Homo sapiens
  misc_feature (1067)..(1067): n is a, c, g, or t
ggattgcttgagcccgggaggcagaggcttcggtgagccaagatcgcaccactgtactccagcctgggcggcagagtgaaactgtgcctcaaaaataaataagtaaataaataaaataaaataaaataaagtgaccaacccccaagccccactgcttcctcatggatatctccaacattcaaggcctatcatggtctgactccagccttcctccccagcctcctctgcatgatgcttggcaggcagtggatacttggagaattagctgcgcctccagtaagtgctatggtctattgaaacaatccctctgccctcagcacccgcacatcccctggattaagtctcaccagcctcaggactccctcttacacccaccgaccccagcaactgctctttctgtgccctcccaccctgcccacgggagtggctttaatgctgcctacgaatgcttaccataggccagcatctgctctcctctgcctgtcccggtcctccttgccctgccagctggggccttcccctaaggcaagggtagcggtccgttcatccttgtgtccacagcacccagggcaggctcaggcagtccatgggggatgggggtgatgatgtctgccggagaagcagtaatgtttctcagaggctcccaagtccccttatattggttcccctcttgactttggaagactccaggttctacctgacccaggaatcagctactggagcagcttctcctgcccagttctacagcttgacttttacaacaatgccaagattttacagaaggtgggtggggaggaaaaggcccagaaggctgctaagatcagcgagggaggctctgccaacaggaaggaaagttctgagcaaaagaggggtagggagggccgggtgcgatggctcacgcctgtaatcccagcactttgggaggccgaggcaggcagatcacgaggtcaggagatcgagaccatcctggctaacacggtgaaaccccgtctctactaaaaatacaaaaaattagccgggcgtggtggcgggcgcctgtagtcccagctactcaggaggctgaggcnggagaatggcgtgaacccgggaggcggagcttgcagtgagccgagatcgcgccactgcactccagcctgggtgacagagcgagactctgtctca

SEQ ID NO: 45411 - DNA, 1478 bp, Homo sapiens
tacagtatctcaagtcatgctgtatccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatctgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcgggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataataggaaaaattggcattgggaataggattttattttaaatgtggaaccatccaacaacctaccaacca

SEQ ID NO: 45412 - DNA, 1030 bp, Homo sapiens
tacagtatctcaagtcatgctgtatccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatctgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcgggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctgggtaattattaactgggtttcgttccagctacttgaccaattatataacaaaaagaaggtggttaactagaaacaaaaatgaaatattacaaggaaatagcggaaagtcagttatctcaaaggtacttattttgaattttgtttataagatgtgccttatttaatgacattactaaggaataaatatttccttaatattttttccaataactttca

SEQ ID NO: 45413 - DNA, 1413 bp, Homo sapiens
tacagtatctcaagtcatgctgtatccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatctgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcgggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataatag

SEQ ID NO: 45414 - DNA, 762 bp, Homo sapiens
tacagtatctcaagtcatgctgtatccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccctgctaacgggaatgctaatgaggaaaatggggagcaggaggctgacaatgaggtagacgaagaagaggaagaaggtggggaggaagaggcaggcggcacgaaccaaggtgatggtgcaggaagaggcatggcagatgcaagatgaggaagctgagtcagctacgggcaagcgggcagcctgcaagatgatgaggatgacgcatgtcgataccaagaagcagaagaccgacgaggcatgactagacagcaaacaaaggaaaagttaaactaacaaaaaaaaaaggccggcggggacctatttcaaccatccaaattcccggtctccagaatcctcaacacggggggtcccgctaccgagtcacaagaagcgctgcccggccaacacggcggcacagcaggcccctgcacatcgacacagccgcactccacccacacgaacgcacaccacgggcacaatttcgccccagggcacgcaacacaagcaaccacaaacattcaggcacg

SEQ ID NO: 45415 - DNA, 1457 bp, Homo sapiens
attaactttctggaaactaacaaaactcttttgtacaagagcttaatagaattggaccctgatcccaactcaacacaatggcactgctgaggtcactacaacttcttacatgaaaagaagctacctatactagcttgccacacacaaagtggtctattgtctctaatgtacatggtaatgggacaataacacattacccaggacttcctgctggtcagtcaaggcaggatatgtgcaactgtcagcatcccttactgcacctgggttaatgaaatatttaactggcttggctccagttggggagcctagctgcagtgtgtatcctccaagtgggcctaattagagactcattcttgtatatgttgcccaaaacaatcagaatgtatttggttaaggcccctataagcacagttaattagagtaatttgatggggtggcctatgctcctgagaattcttagctagctatttgaaaagtgagggatggagctgtagagagtggatctgccatggtgcccttgtgacctggcatgcatatatctatgcaagctaggcttgaattgcaacttatctgagtcttggcaggatgtatcatgatcctcccagaacacaagaggatgggagggtggtgaggtgctgtttcaaggctatctctaacctcctaatctctcctgggaggctgccactgagacagacagtttctcatctgagtactattgaggtctgaggctatctgctctgccccactcagggtatagctacagaatataaaactgctagctgcagtctaaaaggggctcctcagcaagggagtgtcccataactggtgcagcaaacatgcaggccttgtttcagaagtcctgtttggtgcagggaacaaggacatggggagctggcacctttggcccatcttcctcttgctgtctatgtaggtaataaactgaatcttaaaaggacatgtcattactttagaagccaaatcaatcactcttgggcttggcctttttttgacaatgtggtagttatgtacaagagtgtctttgtttttgagaattgtacactggagtgtttaggactgatggaacatgtctgcaacttggtctcaaatggttaagaaaaagccatatgataatggtggtacacacatgcacgcatgcatgctgcagaaatgtgaagtgttaccaattgaacaatctggatgaagtgaacatgggagttctttgtactattcctccaactttttggtaagtttataacaagttactttttaaaatctactgagcttaaggccagggggaagtcttatttttcactttgaactcttctgtaaattgtgttttgaatttctacaatgagtatgtattactttcttaatacaaaattaaagtgtccgatttttaaaatcacaaaagtaatataataaaggaaacttgaaaaatgtgaaaagaaacctataat

SEQ ID NO: 45416 - DNA, 213 bp, Homo sapiens
gtttataaaaagtaacttgtttataaacttaccaaaaagttggaggaagatgatgtcttatttttcactttgaactcttctgtaaattgtgttttgaatttctacaatgagtatgtattactttcttaatacaaaattaaagtgtccgatttttaaaatcacaaaagtaatataataaaggaaacttgaaaaatgtgaaaagaaacctataat

SEQ ID NO: 45417 - DNA, 325 bp, Homo sapiens
catgagggaaggtatttcatcaaaagatgagaataagtcctataaaatgaaatattcaaaagaagaaatagcttttggaacttagaaacaggatagctggaaaaaattttacttctttacctttgtttcctcacactctctgccctgaccagtggcaggcacactctgcccctgctatttacagttgctgttccttctgtctggaatgctctgtctctagatatccacatgctttattcacctctttcatgtctttgctcaaatacgtcttctgagtaaagttgttcctaactaacctatttgaaatatttttaaaaacagaaaa

SEQ ID NO: 45418 - DNA, 456 bp, Homo sapiens
attacaggcgtgagccaccgcgccggcctcagcaagaatttttaaaacatctactatggggccaagtcttgtgctagatgttgcagatacggagatgaatagagacacctctaattaattaaagcggatgccctccccactcctcccaggatttgactcggagcacaaactcttcacaaaccaaaatgtcaggacaccatcgccagtgtccactggccactgctgttggtgtgaggcagccaggagcccctcagaactagtaagtctgagaagaggctgcacggggcctaggagagggagaaatgagcccgtccaaggtgaattccttgattctccattgtgagtgcaccaagaacaagcactccctccgactgactctcgcctaccaggatctggaacaccttccattaatttattcgttcattcaataaatatttattgactgactaacataga

SEQ ID NO: 45419 - DNA, 240 bp, Homo sapiens
atgttctaaaattaaaatgattgaaaattccaatattttttcataaaagcagacaacattgttcacttcattcctattacctttgcttttcaataattgtgaaaaccagactttttgaagaaaactatgttatcattaaacatgttaatatttactttcagtctgaaaaaatatacatgataaaatgcattatacaaatgatttaggcattttaggccttttcaatttgaaatgaaaatg

SEQ ID NO: 45420 - DNA, 459 bp, Homo sapiens
tggagacagctttcagaatgcttgtggtcaacttataaagttactgctaagttacattgttaaggaggcacaaggcatgaaactcaccttgaatagagttgcaggaattatgaccaagagccaggcatgtatgcacatgagcatggttcttgtatgtatctgaaaatgtgcacggtatatgtttaccaagtaagtcgttaaaaactttggggcatgcacaactattgtagcacaactattgtagcacattagaagccaacaattttccccacatagagggaataatctagacttcttagaaaataataattattattattgagatggagtttcgctccagcctgggcaactagagtgaaactctgtctccctgctgccaaaaaagaaaaaagaaatacctttcatgttccctccaagttttttgttaaaaaaaaataaaaacccccccctgtctctcca

SEQ ID NO: 45421 - DNA, 600 bp, Homo sapiens
ttgaactccctgaccttaagtgatccgcccaccttggccctcccaaagtgctgagattacaggcatgagccactgggcatggccacatttgataaattttaataaactgattagtaatcagaaagtaaggggtaaggcattagaagtggctatagtggtttttataattatcttaatatttaatactataatacatttgtttaaaaattctttctagccattattcttttagcacttcatatgcagatacatatgtatacctgttagtacattgtctgcattacatgatgaaattctgcagtagtaacttgatgtagacattgggtatatataatataaaaactcaagttgtgtttatttcaaatgctgtcctttttaattaaaatttaaattttagtgtttagattttatttgagaggctggaaatataagaaaatgaaaatcacatttagtatatttttcaagaaaagagttcagtttatgaattttgggtgtcccagctccaactgaacttctgaaacatactagaaaaatttgcttcagtaataatacatgtttttatttctgtagcctatgaggtaatgtcttagaaaaaaagaa

SEQ ID NO: 45422 - DNA, 701 bp, Homo sapiens
aaaatggtggaattgttcaatgatatttaggttttcagaaatgtgaaattatatatacagttatcctcgaacagtgtggggtttagtggtgccaaaccccagcatggttgaaaatccacatataacttttgactcctaaaaatcttctgatagcctgctgttgactggaagccttactgataacataaactgacaattaacacataaatagactagtttcttttttgttgttttttgagacaaggtcttgccctcttgtccaggctggcgtgcagtggtgccatcatagctcactgcaaggttgaactcctgggctcaagcgattctcctaccttcccccgcgccaccaagtagctgaaactacaggtgtgtgccaccatgcccagcacattttttttctttttagtagagatgggatctcactgtgttgcccaggccagtttcaaactcctgggcttaagcaatcctcatgcctcagcctcccagagtgttgggattacaggtgtgaactgctgcacccgaccaaatagactattttctacatatattttatgcattcggcatacctaactttttcttactctttttttttatatttctaggctacacagttggtctgctagtttatatttattggaaaacaaacaaacaaaaaaaagcttcaccctaaacaatgttagagtaaaagcaaacaaaaaaga

SEQ ID NO: 45423 - DNA, 483 bp, Homo sapiens
tacatatctacatcatcattttaggggttttctcactcagtttaaatattccattccattaaatattcctttgggcaaatagtttttttctaaaattctcaacagcatccatcagaaatcttactctttgaatctctcagaaatataatcaattcaaactaggatcactatggctatttttaagaaaacattggtgattattaccatcagattctttatttgtcacataccaaagcagtggctgaaatgaatgatcctatcatcagctttcccttctgtcccctctttacttttatcctgctctttccttgtgcttttgagggtgatagtggggagcagagaattaccagtctcagtaaagaaatattcatatttggtgaagaaagtcctaaaatgataattcagacatctgggtaaaaaaaatgagttaggtattatcatccctgatttcatcatggtagcaatgggccttgctagaaaaaa

SEQ ID NO: 45424 - DNA, 578 bp, Homo sapiens
atatgatttctcactgctaaacccaatggcctgctattcctgttttatagtaaaaagatttccttacttgttttaaatgtatttcctaacagattttttgtcagttcactgaatggagtagccaatcacttgattactaggtaattcagagtagatttcagtctgttttcaggtctactggaaaaccataaatgaggttaaaatgaccagctaaagcaaaataatgtgtcatttgtagttggcaagaggccctcattttttaaaaattttcttaattcccatcaataatatagtgataggaatatattcatcacttttgattctagttttaaaagggaaagagctaactactaaataatcattgaaaatgtagggcttcctcagaaatgtgagtaaggatattggaggcaggagcatgaggcggcagtggccaggcgcaggccaggaccccactccttccagtggcaccatggggaaggccatgagcaactcaaagcaggcactgccctgcgtggccaagttgcggacagtccacatggaggtgcatcagcacagaggcagcactacaaaaaaaaaaa

SEQ ID NO: 45425 - DNA, 186 bp, Homo sapiens
agagatggggtttcaccatgttggccaggctggtctcaaactcctgacctcaggtgatctgcctgcctcggctttccaaagtattgggattacaggtgtaaaccaccatgcccggcctactgtattgtactttatcccaattctttgatatataaaccctttccctctctttaatcatgattcttt

SEQ ID NO: 45426 - DNA, 804 bp, Homo sapiens
acaacccctctgaaaggcactgtgctgagaaacatgggtttactttacctattgctattttgtacgtttgaaacgatctttccaaaacagatttaataattgaaagttttgctctctgttccttggagaaaagggacatgctttgaggaaggaattggaacccgaacagtcatgttttataggcattcatgtttatttctctgatattatggcttcctctggaaaaatccaaccaacacatccgtttcaagtcttgagaaactcccaaatgttgaccatgtgtctgattcctgtgtggtcaaaagagtgatgttttcttaatgtccacaacttatttccatgttaaaataattccccgctcagctaaatcccacttacacacaagtgtgcacctgttaaaataggtcatttttcactgctaatcttccagattccatgagtatgtgtgggaaccccagacaaatgcaacttgaatgtcacaaaaggcatttttctttgctgagtgaccctggttggcccagacaccctgggtgccttgctcccacagatttgtaaaactaaggaagatccctttctgctgagagaatggattggaattaaatcttagcatagaaggccttgggtgaaactgtatggaattttgtcttacaactgggttattttttaattagatttttgtcgatcttttttcaactctgaagtatgtcagtatggaaactcagtaacttttctcaatgctccccataaagctaaaaattaaaaagaagagaagagaaataaaaagggaaaaaattaaaatttcag

SEQ ID NO: 45427 - DNA, 409 bp, Homo sapiens
atcacagaacaatagtaagggattagtaaagatgtgatagagtccataacaagcatattttgcataaacaaaaattagctttcttgaagaggattccacagaatgagaaagtaacatgaaagataaaaatgatgtgaagagaaatggaaaaataaacttctgctttaataagcctctatgattagataacaagatatttatgtgattacacaggacccaaccattaagacattaaattgattcaggatggcagttcttactaaatacttttaaagtaattttcagcttcactttttcagcttcatcagtctcttattttgtattgtgtcattgcttttcaaatctaagcatatggtttttatcattatatttatctgaagcacacctttttccttttttacagacttca

SEQ ID NO: 45428 - DNA, 477 bp, Homo sapiens
ttttggtctaggtggtggtttcataggtgtttacatatcaggttgcatacttaagatttgtgccctttatatgtcatacctctttttaaattttttttaatgggcaagcttgagaaatagacttggaaaagaaacagaaactaagagaggctaggtcgtcagaatgacagcaatcaaggccatacctggttatgacactgctgttgctgtcactgtcactaagcagcctcatgtactccccactggagttagttagaaaacatcctcattctccattactcctgattcacagtcccagacagaagcatgagattgtactccagcttccaggaggcagagaggaattagcttgcatcctttcttagaatttacatagtaagtagattctatgatcgcagaaggagatttggatgctgagcaggcaaaacagtgacaaatatacacaacactttcctaatcatctgaaccctgttgctc

SEQ ID NO: 45429 - DNA, 318 bp, Homo sapiens
gactctgaggaccgtgcggccaggactctcggaggcaccgctgcctccactccagaagaagaggcgccggggcctgtttcactttcgccggccccggagcttcaagggggacagggggccggggtcccctaccactggactcctcctccctccacccccaccccctcccccgactcaggagagcccccctagcccagaccccccaagcctcggcaataactcctctccctgctggagcccagaggaggagagcagcctcctccctggatttggtgggggccggggaccttccttccgccggaagatggtaagtgaggc

SEQ ID NO: 45430 - DNA, 482 bp, Homo sapiens
tcataattcatcagaatttgaaagaacagccactttgggctaactcagagaaacttgcaagcacagaggcactcgctttacaggcagcacagacacagggaggagctgagtatccatgggaatctgtacaacgcaaggagccattattagaaaccaccacatatcaagtcctgtgcaggcactgggggaaggaggatacaatgataagcagacaggatctccttctcaatttgctttcctatatttgcatttggtcaatgtgcagaaaacagttaacatagcaggcctgacactgctattcttagccaggcttacttgcctttctagattggcccttgactggcatctggaaacttgaatctggggagggtcccatgatttctagcagtgatgagtgccacaaggggtcttaacggtttatacaaacaaaatggttcatgctgaacacctgcttgccttctgggagtctggaatttgggcac

SEQ ID NO: 45431 - DNA, 395 bp, Homo sapiens
gtttcctttggctttgggtccctattctaatggatgacacttctattctttattttaaactatttgacaaaataaatactacgcatattacatgatattaaaacttaatgggattattcatcattaagaggagtctgatcttcattgttcttatttctatttggatgctttcacacattattttatttaatcctcaaaataatcagtatcttcattttatacagaaataatagtatatggccaggcacagtgactcaagcctgtaatcccagcattttcggaggccgaggtgggaggatcacctgaggccagggtttggagaccagcctggccaacatggtgaaaccctgtctctaataaaaatacaaaaattagccaggtgtggtggtatgtgc

SEQ ID NO: 45432 - DNA, 401 bp, Homo sapiens
aaaaaagaaaaaaaaaatttttgaaagattttaactgctaaaatgctcacaaaataagtgaataaagaggaaaatgtaactgttcaaataataatatatccatttgccaaaactatagatgcatataagaatacacaaaactagatgaaacccagttgttaacatagttatatctgagtgatgaaatatttatttaccattgtaaaagttaactggaattaacatatattctacaataaaaaaagttttttgttgttttttagagaatagccttctcaaacttgctttttgctgtttaaagttatttttctgaacacagacgaagagaagaagctaaacaaaagctgacatttcaactctcaataccacactttactattaattgttaatgcaaaatgcaa

SEQ ID NO: 45433 - DNA, 1088 bp, Homo sapiens
ggggaccttccttccgccggaagatgggcactgaggggtcagagccaggggaggggggcccagcccctgggacagcacagcagccaagggttcacggtgttgcccttcccgggttggaaagagccaagggttggagcttcgatgggaaacgagagggcccaggcccagaccaggagggcagcacccaggcctggcagaaacggcgctcttcagacgacgcagggcctggatcctggaagcccccaccaccgccccaaagcaccaaaccaagcttcagcgccatgcgcagagcagaggccacatggcacatagctgaagagagtgcccccaaccacagctgccagagtcccagcccagcctcccaagatggggaagaggagaaggaggggaccctcttcccagagaggacacttccagctaggaatgccaagctacaggaccccgctctagctccatggcctcccaagccagtggctgtgcccaggggccgccagcctccccaggagccaggggtcagggaggaggctgaggctggagatgcagctccaggagtcaacaaaccccggctgaggctgagctcacagcaagaccaagaggagcccgaagtccaagggccccctgatccaggccggcggactgcccccctgaagcccaagaggacacggcgggcacagtcctgtgacaagctggaacctgatagaagacggcctcctgaccccacaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgccaaaaacgagtc

SEQ ID NO: 45434 - DNA, 453 bp, Homo sapiens
tccaacatgacaccccccgaagccccaacaccaggtggctggctgtccctgcccaggaaacagggctccctggatttgtccccagcaggaaccagtgagccaggaacagactgacaactgccacaacaccctcctcagccctcgacatgtgcctcgcaaggactcagacccctatccacccccagtccccagggccccctgccagcccctgtcctacaggggcaagacggcaggaccaggcatgggggagctggaggcagggactagaacagagggagccacctggagagacggaggctgtcagtgcctgcctcgatacctctctctgcagagagcttctgggtgggggcttatctcctcccccaggagggtggatctctgtccctctatccccagggactctctcccctcttgtatagaataaaaaaacaaaatcatcgccaaaaacgagtc

SEQ ID NO: 45435 - DNA, 276 bp, Homo sapiens
gggaactgctaataaataagagaccttgttctagggcactgaggggtcagagccaggggaggggggcccagcccctgggacagcacagcagccaagggttcacggtgttgcccttcccgggttggaaagagccaagggttggagcttcgatgggaaacgagaggtgagtggagcctgggacaacaaactgtgggtcctgagggtatctgtccaccaccctctccttcccactccctcatccctggtggttcagtagagaaagcagatgctttggca

SEQ ID NO: 45436 - DNA, 400 bp, Homo sapiens
taagtgcattgaaggaaatgagcaaagcagtggtaaggaggtctcctttaggctagtcaaggtttgtcctgcttcttccccatctacagtgcctggcacaccgtaggcactcaaatattgaatggataaatacatcggagttggtttgtttatactgtgacagaataatatctttttccctctgacacacacatatacaaacacatgtagatgggaattatttatgtgattgtccttccagttttatgatccaaaatgttataactcaatcttccatgttcagaattgtgaaataatatatactgtaaacaccctcccactgcagaatacctaggtcctggattgaacaaatctttgtggcgttgatgattttgcaaaaaggtagagggctgttcttctt

SEQ ID NO: 45437 - DNA, 448 bp, Homo sapiens
gatgccatgcagttagcgtcacatgaagaaaaacaaaatttagggtatcaccccttagaagacggagggatgacagtttcaaggaggatttgttccatcagatgctgggaaggaatttcaacagatgaggaaactgaagagcagagaggctggaagtgcaatggcacgatctcagctcactgcaacctctgcctcccgggttcaagcaattctcctgcctcagcctcccaagtagctgagattacagatgagaaaactgaagcccaagaggggagcaatttgcccaaaggcgccgagtgcatcagggaaaaagccaagctaaaactggtcctgcctcttctttttcacatcctcccagaggatctgcctcccatgagagctgggagagcttgtatattccagaccctctatctgggcctcccatcttgccattaaaatgaacaaaaga

SEQ ID NO: 45438 - DNA, 574 bp, Homo sapiens
tagagctaatagttgtggaatgttaatatttatgcaagagtatggagttcagctttaaaatcgtcaggaaagatgaaacatttgaatattctcttgatttaatattactactgaaaactacacagccatggatgcatgcagatactggttttttgtttgttttttcctctctctcagaacttagcatccttccaggaggactaatagagtagacagttctcttttttggttcctttttctagctattactgagatgactttaagcagtgttaggtaataaaatatctaggatggtagctagttaaaaagaagtttttagtataaatgctttggtttgaatatttgttccctccaaaactcatgtcgaaatttaacccccaatctggcagtattaagagctggggcctttaagaggtgattgggcagagccctgatggatggattaatccattcatgcattaatgggttaaattcatgggagtgggactggtggctttataagaagagacctaagctagcacgttcagccccccaccatgtgatgttgtgcactgcctcaggactctgcagagac

SEQ ID NO: 45439 - DNA, 591 bp, Homo sapiens
aataaatacagcaaaataaatatatgttcagagaaagtaagtgtaaaccacctctttattatgtttctaaggatgtatgtaatccatataacatataaataaccctggttttattgattgatgtttctgtggtattttgaaagttgtaaaatgtggggttttaccccattataggcatttatctgcatggcttgggaatacagtatctgtttttgctagatactgtctctattgggaaggccattgaatgcctaatctctgtgctctcctttgagggttggctttcttcaagaccaaatcccgtaagaaattattcaagaagctcaacagagaagcatcacttatagaattactaatcattacttttaatacattttaaaacattttcttttaaaaaagtgtctataaaatttgtttgaaatattttacagattccattatgtgtttacagattttacagatactttacagattctattatttgtttgttatttggactgaggtctagttctctgctctttaaggtagcgccctgacatcctctcaatataaagaagcctaagcatatctaagcacctgtttaaaaaaaaa

SEQ ID NO: 45440 - DNA, 371 bp, Homo sapiens
aaagttaaaacttttgctagtcacatgaagaactgtgacatcttgtcaccttcataagacatactgcaattatgtatcatatcttggtgtaacttattaatatgaaatatatagcaactggaattactgtaatagttgatttttacaaaaattgaaaaattaaaactcttccaattataagaactttgaattttaatttgaaaacaaaatagtagccatcatttcttgagcctctaccatgtgccaaacatcactgttttatatgcatagattctggtttaagcctgatctatgaggtgtagacactattattatctccattttacagttgaggagattgagatttagaaggatttagtgccactttttgt

SEQ ID NO: 45441 - DNA, 346 bp, Homo sapiens
tggggaacacaaattctaaaactagactgtggtgatgattgcacaacctgtgaatacactaaaaaaattgaattgtacattttaagtgggtgacatgcatagtgtattaattacatttccataaaacttaaaacataaggaatgtgtagtcatagtagctatatgctcagacaatacagataaaaagatctcttaaaaatgagaggggaaattcataaaagcacatacaaaaaattctttttaactgttctcagaaattatatcatcagtagtggcattagcattgttattctgaaattgtctcatatattgttaccattttaatataatatctatatctattggt

SEQ ID NO: 45442 - DNA, 301 bp, Homo sapiens
aggctagaggtctgtatgtacatggcagcagcacctattacaaaacccttgaagtttcagctttctatagttaagagacaaaaggctagtgtggacacacagctcttggaaagcatgtacatttggaggatatagtgtcttctaaataattatacactttctatgagagtagggtggcttacagtggcaggcctttaatcctaaaggttttgagttgaggtttgaatattagagaaaataaatgatcaccctaagctcacttctctgtactctgcaacattctgaataggtctaactttaa

SEQ ID NO: 45443 - DNA, 468 bp, Homo sapiens
cattccgtgctgagcagcagcatggagaccacaccaggagcctctatgagacactcggctctccgggatgcggtgacttaactccgctgggcagattctatccccatgtcactgatgttgaaactgaggcccgagaacatacagccagcatgtgccattgctgggttccagcctcagtctgctgattccagggccccagatgaaccgccaagtggggtgtgggttgtcattttgacgccgaggctccgaagcatgccatggcctcccaaggttcatctcctaatttaatgtcccttctcttgggccccgcacacaggaaccttcaataaatgtctgttaagtggaaggatttgaggggcacgtttgcctaacatggcatgagttaatccaattcaaatgtggagtgaaactcagtgggaaggagagagacatctaagaccccgcaggcaggggaggcggggatgtcaa

SEQ ID NO: 45444 - DNA, 2076 bp, Homo sapiens
tagttagtcacctcgggccggctgctctgtcggaagcacaggccacaacctggggcttgcagttggcatctgaagtggaggacactcttgtggggactgagcactcaacctgtgggggctgatgttatctctccacacaccaagcaagcactcctccagcagacacaagctgggtgtcgtgtagttcaattcaatcctaacactgtgtacctggagataacatcagaccccacaggttgagtgctcagtcccccaagagtgtcctccacttcagatgccaactgcaagccccaggttgtggcctgtgcttccgacagagcagccataaatcagggttcccatgactctccttctcagtttctgttaacttactagaggttctcacataactcagggagacacttacatttacccacttattatgaaggacattataaaaaatacagatgaacaaccagatggaaaagtgtatagattaaagtatggaagaagggacatggagctttcatgctctcactggcacattactttccagaaactttcacatgttcagctacccagaagctgttccaaactctgcctttttgagtttttatggtggcttcattgcataggcatgattgattatatcattggccattgttgatggccaactcaatcttcagcccctctcccttctccataggttagggctgaaagtctcaatcctctaattatgtcttggtctttctggcaaccagctcccatcctgaagctatctagggttccacacctactggttatctcattaacatacaaaagataatccatcatttctgaaattctaagggttttagtatctgtatgccaggaaacagggaagaagaccagatatatatttcacaataccacaatggctttcctgggtctccaggtaaatggcagaacataggacatcttagcataatctcatgagctaatttcttactaatttcttataatacatctctctttatgtgtacacacatgcacacacacacccctattataggttggtgcaaaagtaattgtggttttaccactaaaagtaatggcaaaaaccgcaattacttttacaccaacctaatagtcctgtttctctggaaaaccctaactaatacaaagtttcaccccatggagctttgattctcccacattttggacttgtacatatgtgaatgccaaggaatcatgtggtggcatcttatgccttagcattaaaagagaatcccaggatgggaggagaggtgctagcagtttgtaccttgtgaagtcacacaagtcacacatacctgtatgttgctgcaatggctgttggaataagtacacagagtccccaaagactagtgaggccaagatgtgtgagtcattttccatcacacacaaaaaacccaattgttctaagtatgtattttaccaagcagctttatagaaagaaaaacaaacaaacaaaccaaacaacaacaacaacaaaaaaccttggccaggcacagtggcttacacctgtaatcccagcattttgggagattcaggcgggtggatcctttgagcttgggagtttgagatcagcctgggtaatgtggcgaaacctcatctctaccaaaaatataaaaactagccaggtgtggtggtgcacgcctgtagtcccagctgcttaggaaactgaggtgggaagattgcctgagcccaagaggtagaggtttcagtgagccgtgggaagattgcctgagcccaagaggtagaggtttcagtgagccgtgggaagattgcctgagcccaagaggtagaggtttcagtgagccaagattgtatcactgcacaactgttgcctgggcaacagagccagatcctgtctcaaacaacaaaaacagtccttatatttaatctctcacagataaaaaaaatagtattttagcaattattaaaaagtatcttgtttttgaaagaaatttgtgctatgaaaagggcattttgaatataaactgaaaaattttccatttttaagtgatacagctaaaaattattacagcttctttaaaatccccttatcagcatgcc

SEQ ID NO: 45445 - DNA, 254 bp, Homo sapiens
aatggaattggtttaattgggattgaaaactaaaacttggaactaagatagagaagatgtagtgtgtgtagaagggctgttaaaaatgtaaaacttggttgcattatttgtggaggctcaaacttgtgaaggctaaataccataatttttccatttgttctgcattttgattctgaaaagaaagctggctttgcccatttcttactaaaaaaacttgtaaatccaaaaaaaaaaaagttgtgtgtctatagaac

SEQ ID NO: 45446 - DNA, 717 bp, Homo sapiens
  misc_feature (1)..(2): n is a, c, g, or t
nnttttttctcttagatctccaggttcccttccttaccccgggagcctttcttcatccaccgtcctggggcgttcacagtgcttagaatcgcagaggttgccgtttctgtacatttcatgcagagcaattaaatagggcactgcatttttcttcaagttaatttttatttattaaagtaaaacataatgtaccttagaagccagacagtcctacaagcttattatgttgtacagcggcgttccgtccccctccccagccctctctttctagaggcagccaatttcagctgtctctctctgcttacctacatatttccatgtttcttggttcatcacctggtggcaccttcagtctggaaacacctgcccttcactttaggggaattgggcccctgttcgtttgataagttttcctaccattttctgatttgttttttctttctggaaaatgtattagtcagatgtaggcttttctggattaatccttcaactttcctttctttctttcccttcctgcctgtctccctgttctttcttacactttctcagggagattcttgactgtattttccaactttgtatcgaccattttacttttcctgccatattttcaatgtttactgatgtttctctgccctttcagtgcatcctgttttatttcatgttagactgaatcatgtgaaattgataacaggttttcagccacacacacacaca

SEQ ID NO: 45447 - DNA, 446 bp, Homo sapiens
ctcttagatctccaggttcccttccttaccccgggagcctttcttcatccaccgtcctggggcacctggtggcaccttcagtctggaaacacctgcccttcactttaggggaattgggcccctgttcgtttgataagttttcctaccattttctgatttgttttttctttctggaaaatgtattagtcagatgtaggcttttctggattaatccttcaactttcctttctttctttcccttcctgcctgtctccctgttctttcttacactttctcagggagattcttgactgtattttccaactttgtatcgaccattttacttttcctgccatattttcaatgtttactgatgtttctctgccctttcagtgcatcctgttttatttcatgttagactgaatcatgtgaaattgataacaggttttcagccacacacacacaca

SEQ ID NO: 45448 - DNA, 499 bp, Homo sapiens
  misc_feature (1)..(2): n is a, c, g, or t
nnttttttctcttagatctccaggttcccttccttaccccgggagcctttcttcatccaccgtcctggggcgttcacagtgcttagaatcgcagaggttgccgtttctgtacatttcatgcagagcaattaaatagggcactgcatttttcttcaagttaatttttatttattaaagtaaaacataatgtaccttagaagccagacagtcctacaagcttattatgttgtacagcggcgttccgtccccctccccagccctctctctgcttacctacatatttccatgtttcttggttcatcacctgaacgtcatcagctgtgctcctcttacggaagaggggacctggctcccttccaccccgacattgcccacccctcctcctcctcagttataccagccatgcttctgcccttcactttccagccaagaaacaaactttaattatgcaccctcaatagatacatcttgttttttcccgggtaagtaaacatctctt

SEQ ID NO: 45449 - DNA, 455 bp, Homo sapiens
tccactgcccatcagtgcctgctgcctgctcagtgaatggtcaccatggaaacggcgctcaggcctacccacccccaccaccacgccttggtcattgttccttccatgagtgagtgctgcccagcaagacaaagtacaggctccagtgggaaggccaccatgtcagccaagtcccttcccgaaggaggtgcccgcatgcttattcagtgtcactgtccactccttggcagtgactcgggtggaggcgaaacatgactaatcgtaaatcacccctgccttctcccaagtgccacacggtttgttgacacggtgtgcgcctggggcgttcacagtgcttagaatcgcagaggttgccgtttctgtacatttcatgcagagcaattaaatagggcactgcatttttcttcaagttaatttttatttattaaagtaaaacataatgtaccttagaagcc

SEQ ID NO: 45450 - DNA, 297 bp, Homo sapiens
tttagtagagacggggtttcactgggttagccaggatgtctcaatctcctgacctcgtgatcggcccgcctcagcctcccgaagtgctgggattacaggcctgagccaccgtggacttctttaaataaccatagtacaggcagttacttttgttatataacagtatagttgtctctgaagaaaacctgaagctctgcaaaatcgggccctgaaaatcggtttctgagtggcttgttcctgtgtaaacttgtaatctctgtagtaacgaaaccagtacccattctaataaaaatatta

SEQ ID NO: 45451 - DNA, 409 bp, Homo sapiens
ccaagtatgtgaaaaagagacagtgagaagaaactgtaagaacagtaaggccaaaaggccaccaggtgaaaatggttctgctgaaactccatctgaattccactccagttttcatctcactggacaccaccacatccaacatcatctttggtgcatggatttcataattgctcacaggacttggatattattctcagcatgattttggttgaatgacctcactaatattcatggttgtctactatgttgtctccaatctggggaggaaaggtcttattagaagacgaatttaattatatatacaattatatttatatatgttacatatatagataaatgacaaaaattctgcttcagaaaagaagtgatcggcattctttctaaataattttaaaaagaactccagaaa

SEQ ID NO: 45452 - DNA, 1514 bp, Homo sapiens
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgatttgaatcaagaattaagagattagcagctgcaagaatttattcataataatgttctaccagtataaaaaacttcaatttctttttttatatatatttttaaaatacactaagaaacaacaacagataattttatcttgtcaaatggcaagaaatgcttgatgagcgaacacaagtttactaaaaaaatattatttcaagtcatcatggaactgtattgttgatcctagaagacacagtccccaaactgttaggttccttagcactttaagatcttcaactacaccatttcttgaagaattttttaaaaactactctttcaagggtattacagataaacccgtggatgttttactgtccatttttgtcatttttttctttgagattttttaattccacaaatcctccgacgtcacctattattgtatgagtaacttctattcatttcccaatgaaagaataatagcttcttaaatatttttatcatgtttaagggtgtgcatatttatttaatcagaagtaaaacaagaacaaattctaggaaaaagaaattcagtaaggaagagggctttttcgtctaattttaactaaatctttgatatttgattctctactcttaaccaaagtattcaaattatttaggaatttcaatgaccttgctttctaaattaggaaaacagccacaccaatcaatttgctaggtgccatattgctttgtataagttattttccatcaaggatttgtgtctgctttgtgtgctgctatataataattatgtcttgctgaagttcttctgcttattgaattcctctactgaagttccttacttattcaaataagtaaggtaggaggtacttagtcaattgagcagctaattggctaaaagtgtcttgagcacaagataagcatgtactgaaaaactgagtatctcttgtccattgttaactgtatttctaatggttgattgcatttaaattaaataattcacccctacaactgcgact

SEQ ID NO: 45453 - DNA, 1130 bp, Homo sapiens
atcggttacgccaccgagtagacaaaaatatttcccctgcatctacacagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatctttcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaattacaaataaaataaaaatgaacaacattttgatacccaaaatgaaaattcccatcagcctgaactttatgttgtgaagttcatgaatgtcagtgaggtatctctgagatgtttcttagcagtcatcctggtgtaagcatgcagttatggcataggtttgtgtgtgttaataagcctttaaaacatatgcaaccac

SEQ ID NO: 45454 - DNA, 588 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaaggtaatgcttattttgaattgatattttttcattctgtataactctacatgaaactagttgactttccttgattattcgttttagatattgaattacccatcaaaaaagtaaattattatctgaaaagccaagggaaggccttacgatgatcatcagattgataaagtgaacagtacatttttagatatataatagcttttcaaaacattgtgggtaatggttaattttctgataccattttgaagtttatgttaatatataaataggatcttgagtacaggattgcagtctctttggaaataaatccaattggtttatcatatttacaaatgataggtaataacagcattagacccttgttagggtacaatgataagattctttgtgactttatttggcgttagtcagatgactttatgtatttttttgaata

SEQ ID NO: 45455 - DNA, 376 bp, Homo sapiens
aagtgaagtggatttaacattctcagggcaaccctcaaccacagatgcacaggagctgagaattctcccaagccaaatacctgcatccaagatcttgtcatgttctattttggagaaacccaaatgaagatgtattcttccttgagtaatttcagatgctggtgtcatctctggatcctctggggttaaaaatccatggacacaatctctaaatcctattccagttccagcctcctatggtcttagagagaaaaatctcattaagtgagaatctaatgggctggaaaaattcaacagactaacctcagatgaagtaatatatttattgaaaaaaatagcaccttgttagctggaaaataatgatacattgacttac

SEQ ID NO: 45456 - DNA, 3173 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatc

SEQ ID NO: 45457 - DNA, 4067 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatcttcaccttggtcttttttgtttgtttttattgtcatgaatttgtggtgggggagatgatcacagatgtttcccaaaatctaggaactacttcaattcatcatcagcatattgctctgaaagaaatccattttaaaaaatctttcttacatgattcagtactgtcatttctagttctaagcttctatgtgttgagcctagctgattgagattggttcacaaagtgtaaatttcattcatgagtatttaaatgtttctgaggaaacatggatcatttcaataggactaggggtgattcacagagcaccactctccaaccaaatggaagagaggagagggggaaaaggaacatattttttttgtgatacaacttaatagcctatgagaacacagtcaacctgagaatcaatgtaagggatttaaaaaaaatgtgtagccactcaattaggtagagttaactcatgatctggaatactgaggcagtttgcaggtatgttccacaatgatctctatcatccagtcaaggtgtgactcctcccttgcaacaggcatatgcatggagtgagtaaagtggtcaacagacctttcaaaaccatggcatcttttcagaactctgacttgggttgtgtgatctagctgtgaatgtagcaatatagaacgtttaatagaatgataagcaaaacactgcaatgatctaaaattacaaataaaataaaaatgaacaacattttgatacccaaaatgaaaattcccatcagcctgaactttatgttgtgaagttcatgaatgtcagtgaggtatctctgagatgtttcttagcagtcatcctggtgtaagcatgcagttatggcataggtttgtgtgtgttaataagcctttaaaacatatgcaaccac

SEQ ID NO: 45458 - DNA, 3032 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatc

SEQ ID NO: 45459 - DNA, 3356 bp, Homo sapiens
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatc

SEQ ID NO: 45460 - DNA, 1620 bp, Homo sapiens
gatacacatcgatgatcggtacccgtaggcagcgccccagatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatc

SEQ ID NO: 45461 - DNA, 2308 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgatccaaaaagactgattgccaaggtagcatggccaacacctgcatcattctcttgattgccttcttgaatgtgtcctgctgttcattctgagacattaatttcattgccactggaaaatgccaaataataaaaatatggaccttataattagacattttaattagtctgataaaaattttgtataattcttaaccatataaaagactttactaaaaaaaacagatatatcaggttaagaaggaacttaaataaatgtgtaatcacaagcaccaaattagttaaatagcactttatcaatcactaatgtgagcaacatggaggacctctggggttgcc

SEQ ID NO: 45462 - DNA, 1051 bp, Homo sapiens
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccatagctaactcatccagaatttgagtataagtggatcttgaggtcctcagagctgagacaacttgagacaacttgctcagtcacctgttcaaatgtctgcaggatggttggccaagtgcaagacatcacatgagcttcttgacagctgcacgatggtaacttaatgagacacaacagttttcttgtgaaatagctggacatgcagagaggtcacatgaataataagctcacacctgtgttcccgccacccggatattattcaaagcacaaaacatcataaataaagtcaaggtcctctatatcccc

SEQ ID NO: 45463 - DNA, 597 bp, Homo sapiens
aagtgaagtggatttaacattctcagggcaaccctcaaccacagatgcacaggagctgagaattctcccaagccaaatacctgcatccaagatcttgtcatgttctattttggagaaacccaaatgaagatgtattcttccttgagtaatttcagatgctggtgtcatctctggatcctctggggttaaaaatccatggacacaatctctaaatcctattccagttccagcctcctatggtcttagaatacaaagaaatggtgttacctggcaagaggtcttctgtcttttatgaaaaattagacaaaggggcgctgttttggggaaatggcagaactccctcagaggccgatctaagggttcccggcagaaggggccatcttcagaggctctggttgcatgactgtttggagtttgatggcctgaagatggaagaagctattcagggaaggagtgacttccagctttgaaacaagaactttagaaacttcagaagcatacggaaaaggaaacaagaaaaatgtaatcaagcaagcctcttgaaatgatacaataatataatagcagaattagatccacagaatttatacaattaaa

SEQ ID NO: 45464 - DNA, 751 bp, Homo sapiens
gaacattatttttaaaaaatatagctaaaaattgtgctataaattaaatattaaagatttttaaatttttccaggtattcagaaacaggcagaaatgtgaaaaactcaagaaaattttatagtatcaaaaatgaggctattatttttttctccctctctctctagagagttttcagattgtatcagatataaaaagaatgtgttttaggaaatggagctgaagagcaaaagaaaggctaggcactcttcactcgtacaacttgagctttcatctgtccatctttcatttttaagagaagaaactcactttttacctttttgacagcacttctgaaaagtgaagtttcattagagtgatttgatatatttccaagcacaaataaagctttcttgtttgcctgctggagaaagagggaatttgaagcagcagaagcaattagggtggcaattgttaggcaaatgtggtggccagccttcaagaaatggcatacttgaaccaaatacctgtcttttagtgcaattaagagaatctatcttgttcaaagacctaactatgctgtttgtttagaaagccaagtaaatttcagtaacaacaccatcatcacttatatttccagatttgaatcaagaattaagagattagcagctgcaagaatttattcataataatgttctaccagtataaaaaacttcaatttctttttttatatatatttttaaaatacactaagaaacaacaacagataatttt

SEQ ID NO: 45465 - DNA, 3201 bp, Homo sapiens
agacagcagaaggatcactgggctggaagctctaacaggcattgccagcctagctacctgcagtttgaggcaagggcagggtcacttaccctgctgtctgaatgtctcctgggacaacaggaggctgcactcactggctgagttcagacagaagagggatcatcggactggaagctctggcagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatc

SEQ ID NO: 45466 - DNA, 4334 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagcagacaaacccagggagcactgaatgaatccgatgatcctgaaacaggctgtctaactgataacaagccaacttctcgacacttctatcctgtcgccttgctgcttgtcagctcacacctgctagttgtgtggcttattttaagtctggcgttactcttagccaaataccaataagtttcatgtcgtattcctttttcttttctacaaatgacaatgaactttaaattatggggacaatgctgtaatatttttacattttcaaattcacagaatttaaaaaatgttaaattgtgtttagtttgtttttcctaaaatctaaaaaacaaaaagtactatgcattaggtggattattttgctcttttgttcatggaaaagtgtttcccactgttaactagctcaagaagaatttttaaattactgtctttggaataagacaaagaacagaatcctgaaagcttgaagttctgaacctcctgtcctcatcccactaaatttattaaagaaattaagactgaaatttgcacaaacactgaaaccctgagacaagttctagagatgtgggaggttgcagactttatttccactgtgctaatatcatagatgccatctgctgatagaaattttttttaacctgttttacttctttgctgcaattaactcttttctgtcaagtaactttatggagagaatggctatttatgttttgtaattaaattacctgtttgtatctcttgtttgggttgatttggctttcagaggacttttctattctttttaacaaggtcttgtttgtgtcttgatgtaccattcccagcacttgtgacttttgtactgtccgtggacaagcactcttcctttataaagctgagacttggcccaggctgttcagaaagccattttctctcttccttgcacagctaaaataataaaatagacgatgaaatttttctttaaaaatctatagggccagacttaataaattaaatgccttatttctagaacctgcatccttagggctacatatagattttaatgtgttttaaagagactgagaaattaatttgtggaaatgttataaaaaggcagatatatttatgaaactaaagtggagctgtattgtggagcaaattatatttaaagagtttattaaattttaaatgttaagagtaaagagacttaagtcatctctttcagagggcaataatggtattgggcctggcctaggatttaattttgtaagatgtatcatcacttgtggaaaaaaaaaatgtagagttgaatctttgttatttttacttggatggttgctgcaactctgcattaaacaaataaagcatatttattt

SEQ ID NO: 45467 - DNA, 2788 bp, Homo sapiens
agtgctgtagctaagttcactttcagcccggcgcagaagttttccctgagatatggtgttagtttcttttctttctgtctcctctgccgttgccagcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttcagttggataatc

SEQ ID NO: 45468 - DNA, 2808 bp, Homo sapiens
cgcacacgctcacacgctcgcaagcgaacgcaggaaagtcaggctaaaagtgtctgctgctgctgccgccccccactccgcctccgggagagaatacaaagaaatggtgttacctggcaagaggtcttctgtcttttatgaaaaattagacaaagagccttgaaaccagcgaaacaataatcaaagagcagttctgtcaaagaaaacaacataaatcaggtacagaatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggcggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggactgctaagtacatacagcgatgaaattggaatgctagaggacatggccgttggcatttccgatttaaagaaagttgcatttaaaataattgaagccaaatccaatgatgtgttgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaagttggagatgtctcctttgctagtaaggattacatgcggggccacttcgaacctccactagtatagtacaacatatgttatcggaaagatgcctgtagaggatatatgcgacgattttcaggcgctcactgaccttcgcatcttgtctcagtaatcatcctgcgtataaaccctatgccccgaggagc

SEQ ID NO: 45469 - DNA, 421 bp, Homo sapiens
agccaagattacatcattttctcattctctgttcatagctgggaaaggtttttccatagtaaagctccctctccccccgaaaaccccagctccctccgcaggaccctcttgggccttcctgtgaaggcttcctttatcccataaagtttagtttgacaaggagtcttctgaaagcagattggtcagctgttaaagaaatgacatcagtggtgattccattgattcgttcaattggcttaaggtggaaaccatattgaaatgaattcttttcattcacatattattgagccccaaccatggaacaggatctggaggtaacaacactgaataatagatgacacccacctgaccagaagagtaaaagagtttaaatgtattttgaaatgtttttcaagtggtataatagcaaactcactaatta

SEQ ID NO: 45470 - DNA, 398 bp, Homo sapiens
attcccatgctcaggctactgagatggcatgggcaaagaccagatactgtgcccaacacaagacagatcctcaataaatgtctgtccccatctcttcctcctaactgtcccctctgctacacccaaactgatcagtgccccacctgtcttgggctttccatgcctctgctcttggccctcccctcaccttttagtcccaagtccattcatccttcaagcccagctcaaagccttcccttctctaggaaggcttcccagattacccagctgggatgatggctccttcttagaaactctacaccagcactgtcagcctccgtcgtccagcacatatcatacactctatgagagcattgcttatctcttcttgtgtaccagtcttatctgcttaattaaaa

SEQ ID NO: 45471 - DNA, 476 bp, Homo sapiens
caaagctgctccagaacccctgaggacagaaagcccttggggccaaacttgtctggggcaccttacacaagggtcccagcggggctaaaacttgatcttttaaatttttttttttttttgaggcagagtctcagtctgttgcccacgctggagtgcagtggggcaatctcagctcactgcaatctccgcctcccaggttcaagcaactctcctgcctcagcctccggagtagctgaggaccatcgttggatggtcctcccctcaccttttagtcccaagtccattcatccttcaagcccagctcaaagccttcccttctctaggaaggcttcccagattacccagctgggatgatggctccttcttagaaactctacaccagcactgtcagcctccgtcgtccagcacatatcatacactctatgagagcattgcttatctcttcttgtgtaccagtcttatctgcttaattaaaa

SEQ ID NO: 45472 - DNA, 300 bp, Homo sapiens
tggggctgcttttcatgaggtaaaaagtgtgactgaggattcccaaacccttgctatctccctaagtgatttctttttaacttctatatcaaagagactggagatttttttttatgagaactgcatattgcctctttggtttggtttgttttaaaggcaggttatctgtggaaaccttatttatatattaatttgtttctcttactggagctgaaaaactttttaaggagggatactgtactatttaaatacctttctgaagtcccctaactcccagcttcaaacacagctggtttacca

SEQ ID NO: 45473 - DNA, 917 bp, Homo sapiens
atgaattgtaaattatgtgcatgttatttaggcatgttttatgttttataggcatcaaatgggtacttttcatcttatttaaaataagtaaaatgaaaagtaattgttctccagcaaaatatataaattacatttctctctgagttcctgattcaagatctctgtagaagaagaataacaaagaacacctaggaatgatacaaatgatactttcaattttggcacttgtctgccctactgccatgtcctcatgagagtatccctgaactcagttctcgttggtcatttgacgtttgctgggagcgtactatgggcgaggtcttatgctgagggtgagcctagtggtgtctcacttcttgtagcttgggtcaggaaatggagatcagctactgtatcccagaaccttcttgccttcccagtcccaaggcaggtgctgtgggaagagtgtgtataaggtctgatggggacagacctggggtgaatctcagtggcacttctcaacagctatagatccctaagtaagttatctaatcatcatccccacagtgttctcagatgaaaatggggggtaataccccatctcataggagtttaaaaggattaaatagggaatgtagctatcatcttgtgcctggaattctgcaaagcatatgaaggtgcccttggaacttccttcccatttttcatatttgctctgccacctctacacccagccccgctttctgcaaccaattgtattataaccccctcccaaacacttagtgcatcctcccactcatgtaatttgtttaccttgttttctatttatttcttttgagatggggtctctgtcagccaggctggagtgctgttgcagtgagccaagataacgccactgcattccagcctggatggcagagcaagactccatctccaaa

SEQ ID NO: 45474 - DNA, 558 bp, Homo sapiens
ggtctcgaactcctgggctcaagctatcctcctgcctcagccgccaaaaatgctgagattacaggtgtgagccaccatgcccaactaaggaacaaattttaatgggtgcttcttatgtgaaaaacatgggattagacactggggatagaaaaccgaatgacacatagtccttgctgttaggaaatatatggtctgttgggaaatctggcagatccacagacaattacaatcctgaggtaaaccttgggaagggttagaaaatacagaagatgggctgggtgcagtggctcacacctgtaatcctagcactttgagaggccaaggcaggcatattgcctgagctcaggagttcaaaaccagcctgggcaacacggtgaaaccctgtctctactaaaatacaaaaaattagccaggcgtggcagtgtgcacctgtagtcccagctactcaggaggctgaggcaggagaatcgcttgagccctgaaggtggaggttgcagtgagccaagataacgccactgcattccagcctggatggcagagcaagactccatctccaaa

SEQ ID NO: 45475 - DNA, 1166 bp, Homo sapiens
ttgggtgacagcagaagtagctaagcagacatgaggcttgcagctaaggagggaagtcctctctcaagccagcctgtgaagacagcacctgcctgccctgaccctcctgtggcctccaggcctgtggctctggtaacagtttcttcctccctccccgccacccccttcttcttggtgacagctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatt

SEQ ID NO: 45476 - DNA, 1265 bp, Homo sapiens
cagtcagattccgcgggagagcggcagagataccgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatt

SEQ ID NO: 45477 - DNA, 1069 bp, Homo sapiens
ttgggtgacagcagaagtagctaagcagacatgaggcttgcagctaaggagggaagtcctctctcaagccagcctgtgaagacagcacctgcctgccctgaccctcctgtggcctccaggcctgtggctctgccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatt

SEQ ID NO: 45478 - DNA, 1787 bp, Homo sapiens
cttctctgagacttctactccttggtcctagctttgttcctaggcgctgtgccgctgtgtcatccaccctgccctgtacaatatgcaggaagcaagcgaggagggggtgcctcagagagacagtaaggaggaatgaggacaaggtggaattggcatgggcacgtcctacagagtgagaggcaggccttagggcaccacgtcgctctcacctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttgcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggta

SEQ ID NO: 45479 - DNA, 1577 bp, Homo sapiens
ctggggcctaatacgtggtgctccatacattctggtcgactgtatgaatgaagggggtggcccttgttctccttttagatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggta

SEQ ID NO: 45480 - DNA, 801 bp, Homo sapiens
cttctctgagacttctactccttggtcctagctttgttcctaggcgctgtgccgctgtgtcatccaccctgccctgtacaatatgcaggaagcaagcgaggagggggtgcctcagagagacagtaaggaggaatgaggacaaggtggaattggcatgggcacgtcctacagagtgagaggcaggccttagggcaccacgtcgctctcacctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttgcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatt

SEQ ID NO: 45481 - DNA, 591 bp, Homo sapiens
ctggggcctaatacgtggtgctccatacattctggtcgactgtatgaatgaagggggtggcccttgttctccttttagatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatt

SEQ ID NO: 45482 - DNA, 2251 bp, Homo sapiens
cagtcagattccgcgggagagcggcagagataccgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggta

SEQ ID NO: 45483 - DNA, 915 bp, Homo sapiens
cagtcagattccgcgggagagcggcagagataccgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagatgtggaagagccgctctgacccagttctgcacattgacctgcggaggtgggcagacctcctgctggtggctcctcttgatgccaacactctggggaaggtggccagtggcatctgtgacaacttgcttgtgagtgatgtcctggtgccctcgtccgtccctgggcctcacacccagtttgctgagctgcagacatccttgtacaaggagacctgctgctgtggggccccggtctgcccagggagatcgtgctccgccattccccacatcgcccccagtgctctcaccttctctgtagcacatgggcacagccctggtcctgatgggtcagtgtgacctgccactgctccccaggagtgtccccctctcccctgcccttgcacccagccaggtgcccacaggaagacccttcttccttgctctttgtccctcctcgtgggctgcctgggtgtgctcttccactgtctctgcccagccccatcgcctcccgcttcagctctgccttctccgcagatctgggtatacacgtgggcaatgta

SEQ ID NO: 45484 - DNA, 1040 bp, Homo sapiens
cagtcagattccgcgggagagcggcagagataccgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatt

SEQ ID NO: 45485 - DNA, 460 bp, Homo sapiens
tgagcaggggaatattcaagagcatccaagaatgcagggagctaatgagcatgggagtgcagaactgaggtcagaaggcgtggccaatggaaactcccagcagccctgtgcaggggctctgcggatacctgctagctcttggggcttaagcacgcagttcgggactggcagctcaaaaatgtcttgagcagattggcccctcagataaagtgggacacacagtctttttttttttttttttttttttgagacggagtctcgctctgtcgcccagcctggagtgcagtggcgcgatctctgctcactgcaagctccgcctcccgggttcacgctattctcctgcctcagcctcccgagtagctgggactacaggcgcccgccaccatgcccggctaatttttttgtatttgtagtagagacagggtttcaccatgttagccaggatggtcttgatctcctg

SEQ ID NO: 45486 - DNA, 369 bp, Homo sapiens
gcaagaactattatcacccccctttttacaggtgtagaaactcaagactgaggaaacaaggtcacctaattagtaagaagaatcagtagaggttgggcacagtggctcaggcctgtaatcctagcactttgggaggtcaaggcaggtggatcacctgaggtcaggagttcgagaccaacttggccaacatggcgaaaccccatctctactaaaaatacaaaaattagccaggtgtggtggcaggtgcctataatcccagctattcaggaggctgaggcaggagaatcgcttaaacccagaggaggaagttgcagtaaaccaagactgcaccacttcacaccagcctgggcaaaagagcaaaactgcatc

SEQ ID NO: 45487 - DNA, 407 bp, Homo sapiens
aatttatttataatcttggaagagaaaaggtattttgaagcagaacacaaaaccagaagttctcaaagaaaacactgattatattttacccacataatatttgaaaacttatgtatggccaaaaaatgccattagtgaaatctaaacataaatgacacaggggaaaaagttgtaacacaaatcacagacaagggtctaatttcttagtttaggtagagtccttaaaatcaataatttatagaaattaacaatacacattttttaaaagatgctcaatctcatgaaataaaggaataaaattcaaaactatcagatagtttacactctttagaaaggcaaacatttcaaaggtaatgacactcattgttgctagaaagatggagaaaagggtactcccctggattgtt

SEQ ID NO: 45488 - DNA, 346 bp, Homo sapiens
tctcctctgatgagtttaattcagggcagagttttaggtttcagggatacctgccagtccctatatgggcaaaggtggagctggcacagaaccagactaaagacagagcaaggaaagcaaggccagacagggtatacgttcaagctcaatacaggaaggatgagaactgagcctaagacaaagcagaaccaaacaagggaagtgggtggtgggtaggcagggatccaagatccattatgagcctgaatcctttagcctaacatcaaagcccctcactaccggctgcccaggcttctgctccagcttacacctgtaatcccagcaatttaagagggcaaggtgggag

SEQ ID NO: 45489 - DNA, 575 bp, Homo sapiens
gaaaccctgtctctactaaaaatacaaaattagctgggcgttgtggcacatgcctgtaatcccagctacccgggaggcggaggttgtggtgagcccagatcgcgccattacactctagcctaggcaacaggagggaaactctgtctcaaaaaaacaaacaaacaaacaaaaaaactagcagtcacacctagcctatctcatccttatcatgcagcctcctacaagggcaggcactcctggggcttggggtggggagaatggagctggctgggagcacctctgtgggtcccatctgacccctgtgccagggtctgggccagccccttggtcttgctaggcccaggactgattgtgtctgatggcatcagcctggcctcgtgggggaaggacaggggctgtgtcccccagcaggacccagacaactgcctgggccaccagacccttgccctgttaactgtctgcgacccagcaatcagcaccccccaccctttttcccttttcttcattttgacagagacacagagaggtggtgacgctttttgttcagtggtgaataaagtgatctaaaaaaaaaa

SEQ ID NO: 45490 - DNA, 901 bp, Homo sapiens
tggaataattctggtataaaatatatataaatgttacttaaaatcaagcatgtgaggctggacatgttggtgcacacttgtagtcctagctactcgagttctttgcactcagaaattcgagaccagtctgagtaacatagtgagacctgtctcataaaatcaagcatatgtgcacatcatatatatacattcagtcaaattaattttttttgagacagagtcttgctctgttgcccaggctggagtgcagtggcaaaatcacagctcattgcagccttgatgttctgggctcaagagatactcctgcctcagcctttcaagtagttaggactacgggtgcacactaccatgcccagctaatttttttattttttgaagagatagggtctcactttgttgcctaggctggtctcaaactgagcatgatttttgtttccatttatttctattaataataatatgatacttgttaaattgatttattgataattgacagcaggtgatcttttttttaagggaaaaaccttacgggacaaaaaaacccccaggactattcctatttacctaaccttagtttttggtatcattccttattttaagtagttatgaggatactttttctgcattatgtttcagaagcactagtattctagaaaagcgtagggcccaggcagacatggtggctaatgcctgtaatctcagtatttggggagactgagggaggaggattgcctcagcatagtgagacactgtctctactcaagattaaaacaaatcagctggatgtgatggtgcatgcttgcagtcccagctactttggaggctgaggtggttgcagtgagctatgactgagccactgcactccagctggggtgacagagcaagaccctgtcgcaaaaaa

SEQ ID NO: 45491 - DNA, 1640 bp, Homo sapiens
gcagctttgggaagtatattgcgaattcaggctcgtgcgcacggtagttggtggtcggagtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45492 - DNA, 242 bp, Homo sapiens
tcaccaagacctggcagaagcaggaagcaatctggaaacatctaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctgtgcagaagcaggaagcaagcaggaagcggcagaagcagtgaag

SEQ ID NO: 45493 - DNA, 1767 bp, Homo sapiens
atacttagaagcctgaggcggacaaaattgtcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45494 - DNA, 2072 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtgaggaagctaagactagagaagataaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45495 - DNA, 2120 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggatttcaccaaaagaattgtgagaggaaaaagaaacttacatctaacaggaagagaaaagttttaggaagaccaaattggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45496 - DNA, 1162 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggactagagtgccggtaccgagctcgattcgca

SEQ ID NO: 45497 - DNA, 1085 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcaggaggaaggaggaaggaaatcaagatcttgactttgatcttgatttccttcctcctttctttcggctgtatgttctactatctgaagaactgctcgaggaggaccgtctacggtgtttcgttttttctcttgcttctgctttcttcttcagtatctgatgaccaacgtcccatgttctttg

SEQ ID NO: 45498 - DNA, 2043 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45499 - DNA, 1869 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaagggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45500 - DNA, 1987 bp, Homo sapiens
acggggccccttgatttaagaacgaatcagggactcggggtttgcacgtcaacggaagtttgagcccaagggtctgacctgcagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45501 - DNA, 1680 bp, Homo sapiens
ggacgcgtgggtcgacccacgcgtcggtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45502 - DNA, 1645 bp, Homo sapiens
  misc_feature (24)..(24): n is a, c, g, or t
  misc_feature (41)..(41): n is a, c, g, or t
  misc_feature (53)..(53): n is a, c, g, or t
ggccgggggccgcaagggagagangttgttcttaggaaagnggctgcgtggtnccagcccattagtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45503 - DNA, 1395 bp, Homo sapiens
gctaatgttctatgaacagatttttccaccagctgaacaggccaaagccagactacagctggttcttgaagctgctgcaaaagctgatgaagcattgaaagccaaagaaagaaatgaggaagaagcaaagagaagaaaggaggaagaccaagccaccctggtagaacaagtaaaaagagtaaaagaaattgaagctattgaaagtgattcttttgttcagcagacattcagatcaagtaaagaagtcaaaaagtcagtggaacctagtgaagtgaaacaagcaacttcaacatcaggaccagcatcagcagttgctgatccacccagtactgaaaaagaaatagatcctaccagcatccctactgctatcaagtaccaagatgacaattccctggcccatccaaatttatttatcgagaaagctgatgctgaggaaaaatggttcaagagattaattgctctccgacaagaaagactaatgggcagtcctgtggcctaagtaatatacatatagttggattggattgtcagcagtaacattggaaatttaggtttttaaatcccaatattaactttttactcttaaaaagaattttgctgattatatataaaggtagtctcatttcatttgtctctcatgtaggcttgaatatttgttaatttgaattaaatcaaacattgtaaaaattaaaacaaaatttaagattgcatgaaaatgttatactgttaataaagctaaacataaataagtctgttaaaatgaatggtagacactagtgtttcttagtgcaattcaaaaaatgtcaagatgtcatttaaagacacaattttgattaattatgcatacatgagaattgaattacatgctataaatatgagatttcatcttccgtatggtattcaaccatttttaaatattttatttcaccatattgcaaatttttaggcacaataaaaagcaccctaaacaatgtaagcagaatgtgcatgttaaagaacatatttatggaaaaaaaatttttgaaacttaaataaattggtgattttgcttagagatcagcttctactagatgctcctttacaacatgttagcagatctcagctcattgttttagaaatcacatgttcatgctagacctaaccagttggccaaatacctatgatggagaaatcatttctgagaaaactgataagagctctcacttcagtcttacttaccccactgctattccctgtggagaaagccggctaattgttttgataaggctatctgccattgtagaatacctttctctagtagctgaatgacaatcaactatacgttccatactaaacatgccagagataggactttaggccttgctttacaaaactggtttttaacagctgacatga

SEQ ID NO: 45504 - DNA, 1480 bp, Homo sapiens
ggaagctgcctggcgctagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtggggaatctggaaacatcaaagctggattagaacatctgatgggagtcttgctcagtctcccaggcaggagagcagtggtgcaatcttggctcactgcagcctccacctcgcaggttcaagtgattctcctgtctcagcctcctgagtagctgggactgcaggcaccggccaccatgcctggctaatttttatatgtttagtagagaccaacatgattttaccatgttggccaggctggcctcaaactcctgacctcagatgatccgccctcctcggcctccagaatgctgggattacaggcatgagcaaccacgcccagtgactccatgttttttcttccattatgttttaaagttctggataatgtagtgagtagtgacacttattggactactgaatggggtttaaaatgtttactttcagctggggggcttaatgaagtcaacatgtttttatttttccaattaaggaaaaaatacaggagatagccccttgccatttgatgacaatacagctattattattttataagcaaactataaaaatgatgctatccttttctcttgggagaaggatttagatcagaaaatattaagtcgagctgtatgaaaaattacttttttaggtcaaaatagttttgtgggttgtttctggcttgaaagaaggacagctgtgctatgccccctttggcaaggaatgaaatgaattatcctgatcagtatgatgtttctaaagcttcctttgttctcttttctgaaaagtcaaataaatagaagtggcttgtagtaactgtacagggtgatctggggcagtgcttcaccatctttaatgtacatatgagtcac

SEQ ID NO: 45505 - DNA, 562 bp, Homo sapiens
tttgtggctcccatgggggtttgaaggacaagctgggaaacttgggagaaccacagggacacagcctttttctgttcatgggactttcagcaagcggttcctggtcagcatgcctggtcttgctgggaactgggcaggtttccaggttcagttcacatgttgtaagcaggcatggttctaaattaaacctggagccaccgctgtccacccagcactcactgccatggccactgtgcaacgccgcagaccactgattctcaaacatctgaggtgaaggaccagggttgtctttttaaatttgtttcactttcctatctgtcataaaaatgaaatattagaaatgtgaaataaagacagacttctgttattagattcaagagacataaaattgctctgtccatttgccctaaaagtttctaaagactgactcaattcctgaacatgagtttaccaacagcaaagaagttagggccatcgctaccagcccaaggactgtgctttgggcctcactgcccagaggcccaggatctaaggccagaagggaacagctgccctccccacg

SEQ ID NO: 45506 - DNA, 349 bp, Homo sapiens
ccaatcgcctcgtctggaaaaatgggaatggaggagagttgtacctacccagggtggttctgtgggcatttaaagagcaacttcatgtgagacgtggagtccatgtgtggcccatggtgggctccaggaaatgttggtgatgacagggatgagggagcaactgagagccggcagtgaggtgacacacccaaggtcacgccaccagcagaggtagctggtcacgctgctgagagccggcaggaaatagatgcggacaaagcagggtcggttttcagcttctctccacggaaaggccggctgaagtttccctcaccacgcagaaatcgataagcaggaggtttttaaaaac

SEQ ID NO: 45507 - DNA, 290 bp, Homo sapiens
tatttaatcccagacaaaacctattctaaagtttataatacagtccctgcttcaatttattatattttttcctccaaatatttccatttttttgttttaaatattaatcgagtaagtctggttggaatctaggactaaaatctgtaactcttaatattctattgataacttttgttctgttatccccaagtttgcattaatatacacatagattcagggggccaacccatttgtaaactggcagctaagagcaagacaaaaaagttgattcaggacttataaagtaataa

SEQ ID NO: 45508 - DNA, 555 bp, Homo sapiens
gactgagggtcttcctcactcccccgtctccaaatccgttctgttctgtgtctgagggcaacctggctctggctctccctccccacccccagcgacctgcttagagttgacagcaccggccgcccactggagcgtttctgacccttggaacgtggtggaaatgctgctcagcctggggcctgcttgtcctgtgagcattttttttttttaatttttgtttttctttttggcgatcatcttaaactttatgttttcatttttggtgatattttaaagttaaaaagacaattttttttatgagagtaatctgtcgctggaagacactttttatgtttgaagacttgagtattaactcactgctttcagacctgagagctgctagaatatattttctcctaaaaattaaggagtcctttgacctttactcaggccctgcctgacatccccacacgtgtcctggggtccctggcctcaccagttctccaagattgaggctaacgtctgaagtggctgtgagaaggaagagacttgaacagtgaaaactgaaaaacatga

SEQ ID NO: 45509 - DNA, 845 bp, Homo sapiens
aattgtgaccatgtgttagagtatgatagggaaaatggaagaaatttagtagttactaggtcttttaagatagtttagtctgtcacttggctttatttcttccctcatgttggtctaaagctgtagtctctttgtggtagacaggattatccattgtggcatagagagaaaatgttagaattcctacttgtgtttatttttgtcctgtatacataatatcattggtatctgtattagtttcctagggttgccacaacaaattgccatacacttggtggtttaaaacaacagaagtttattctctcacagttctggaggccagaagtctaaaaccaaggtaatggcagggttggtttcctctagaacctttgagggagaattcattccatgctgctgcttgtttctggcttgtcaatagttcttggcattcctttgctcatagacatatcattctagtctctgcttcatccacatggccttctcccctgtgagtctctatctttccctcttctgtctcctctaaggacaattgtcattggctcagtcttatcccggattatctcatctggaaatccttaacttaattaacatctgcagaagctttttttcccaaaattatcacattcacagattctgggtggacatattttgggaggtggggacagggacagggtgcatcattcagtccactacgggaatatgtaactacttttaaaacagaaatggaagagatgtgcactcaaattttatgctgatggtacacctttatcaaagcttgggagacttctagtttagagaactgtttgggttggatacagttggcctcttttcatgtaattagacga

SEQ ID NO: 45510 - DNA, 485 bp, Homo sapiens
ctgctgtattcagcctgggtgacagagtgagactctgtctcttaatcaaataaacaaataataaaccaattttctttgaagtccatacgctaatccgtcctgacatttttaaagctattttctagtaccgtcaatctacaatttatgactgcgtttgtgaattaactatctgcaacaatgtaatatgaattacagatgggttctgtagtgccattaatagtatgagtgtttcagcctcattatggactaattaacatctttttgtgtggagttatacttttgacttctagaaatctagccaaacacattcctccattgcagtccagcagtggcaggaaactcttctttttccctcacaacagaaacagggttgttaaagctttagtgacagcaagagaggcgttttgaagcaatgctcaagagacacaggtatcttgggcatcccacgtgggtggtgggtgataggtaacgctttcagatgaagc

SEQ ID NO: 45511 - DNA, 424 bp, Homo sapiens
ggaaatattttcactatcttttcccagacacacaatggggttgagggaactagattgttttgctggagataaggacaagccacatggcaccaaaaattatttttcttctgtggatccataagaggaaaattcccttggcgtgggcctacccatggaggctcctgtttgttttctactgacaatggttgcacccatgtgatgaacctaacagaaaagaaggttttgcaacatgacactggtacaaaaacagacactcagatcaatgaaacagaatagagagcccatatataaggccgcatacctacaaccatctgatattcgacaaagctgacaagaacaatgtggaaaggactccctaatcaataaatggtgctgggataactggccagctacatgcagaagactgaaactggaccccttccat

SEQ ID NO: 45512 - DNA, 379 bp, Homo sapiens
tagaaattaaaagagaagtgggagcttataggactctcttcctggcttcacagtggagggggttcccaattctgtggaagaccagcctctcttcttcagttctggatatcatctcccattcgtatttctcaagagcccctctcctttagctctttactggaatatttccatgcttttattatgttatatttattatatgatcacaccaagcaataataacatttaatccctatattgcaccccattgaaaaatcaactcaaatggatcaaagacttaaatataagacctgggatctataaaactactagagggaaagccccatgatattggtttggggcaattattttttttttaatatgacccaaaaggcacagggaa

SEQ ID NO: 45513 - DNA, 255 bp, Homo sapiens
gtagatcaaagaagtcactagggagattagaaaatactttgagacaaatgagaacaaaaatatacaataccaaaacttacgctgtgaaactagtattcagggaaaacttaacagttgtaaatgcctgtgttaaaaaagaagaaagatttcaagttaacaacctagctttataccctaagaattaggaaaagagcatgctaaacccaaaaggaaaaataataaaggttagatcagagaaaaatgatatagaataga

SEQ ID NO: 45514 - DNA, 386 bp, Homo sapiens
aaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagc

SEQ ID NO: 45515 - DNA, 372 bp, Homo sapiens
ccaatctggtaacacttctactctaaaaatgtgcttactctttgtatagcatgtaactgctctattggttgtacccattcatatattaatgtttccactttttatgcctcctctgtttttctcatgccttaatgagctgttttatggaatttctaggaggcaatgagttgagttctatagatgacttttgtacatcttgcacatgtacaatttaacacttttttgtgaacaacagatatcttttttgaaaagaggtagtcatagattaatatcatagcaaaatggctgtgcaacggccatccagtcaagattactctttagcttccctttgccccaagcacataccaattagaaaatgtaaaaataaaaccc

SEQ ID NO: 45516 - DNA, 870 bp, Homo sapiens
gaacgttacatttgactgaggctggcgaggcctgcagcctgcaccaggaggtacaatgtgagactgaggaatgggaagaaggcattccatggagctctgagggcactgggtgcaagggccttgcacatgcaaagaccctgttgtgggttcaagccactgtgtgggagggacaggagagcctggcgtggctgcggccttgaaggaggggactgtgcacacagaattgcaagtgggggtctccgcggaagctcctggcagttttaagcaggattattagatgattcagtcaactttacaactcactttgctgaatggagggtggattaacgagggggtagttggaggctaccccttggagggcattctggacttatctaccaaaatttcaaatgcacataccctctgacccagcagttccacttaagtatttggtcctgaaatcttggtaaaagtgcccaaagatacagaacaaggatgttcactatagcatctcttagaatatggccccaaacaggaagcaaccccaacctctatcatgagggaggtcataaaattcctgcacatgcaacagtgccatcctctgcagcctgtcaaagaggcaggcagcactaactgctggactggaatgttctccaagatataataaatgcatttgtttgaaagcagcttgcagcacagtgcgtcaggcctctgagcccaagccaagccatcgcatcccctgtgacttgcacgtatatgcctagatggcctgaagtaactgaagaatcacaaaagaagtgaatatgccctgccccgccttaactgatgacattccaccacaaaagaagtgaaaaaggccggtccttgacttaactgatgacattatcttat

SEQ ID NO: 45517 - DNA, 877 bp, Homo sapiens
gctgtgtgtcttaaactgcattggagtttgtcactgctaataccctagtccaagccaccatcatccctcaatctcatatttcctctctgctatcactctcccctctctacacccacgatccagtctattcatggaagctactatgaaaaagatatactgcatcatttcctaggccttctcccttgctccctggctctagcaacactggggaccctcattgctgtctgaggctctctgctcttgccattgcccctgtctggaaagctctttatccagatgttacttaagcagttcctttttgtcattcgcttctctgctcaaatgtcacttcaaagagcctgcttctgaacagcctgctctgagaataaggggaagaagcagatggagatttctgggtttttttgtaataaatgctattaataaatacttatggtactatctgactaaactgcagatatttatcactttggtaaatgtttacatttaaaccaaatttaagaagaaaaatgtttaaaaaactacacccacatccattgtcactttttgtctatcacctgggcttcaaggctttatcattatctgaaattatctcatttatttatttgtttattcatttattgtctatgtccactcctgtagaatgtaatctccatggcagcagggactttgtataacaatctagttcattgccatatgcctagggactataacatagaagctgttcaattaattgttaatcaatgaataactgtaataagatacttgagaatggttgtctttttgttaggaaaagactaagtactataatcgcaatgtctacataattttaaaaatattcactcctgagtaataaattatttgtggttaaaaaaaaaat

SEQ ID NO: 45518 - DNA, 379 bp, Homo sapiens
catctcaaagtatgttcgttttactgcagaagttgaatgttgaactattttattgataggtttggtttatcttagtatgggttgacagttctaaacctgcttattctatattctaagagtgaccaaatgattaaatatattgagggagacagttttctcacttttggggaatttagttacaatgtggaatgagagaagactagattgtgttgtgctgttaggttggaattgttgtaatcttaattcatgcttttaaatatattacactagatgaatagatctatttatataggtataatatgtatactatagtttgtgtatctgtatactctgctaggagcaatgatgcagcagtagcagtgagcacacagtgagcatc

SEQ ID NO: 45519 - DNA, 965 bp, Homo sapiens
tcattttaaagatcattctgggtctaagaaggataaaaaaagagagcttaatcttaatctggcaataattactttttaaaatatgttaatatttatttattatggataaagatatctactatttagtagatagtgccagttttttccaaagtgattgaaccaatttacattctttacaacagtgaatgagagttgccattttcccatattcttaccagtatttggcatggtcctttgtaatttttgtaatcctactttgtttgtggtggcatcacattgtggttttaattgcatttctctcatgagacctggaaggttgagcacctttcatatgtttattgggcatttggataccctttttaataaaacacctatatttttccatttttctattgggttgtatgttttttgttacagattttttttggagttttatatatattctagataaaagtcctttgtttcatattaccactttattgctttcctttttactctattaatggctcccttccttttcatgtataataaaattcaaaaatctttaatatactacttgacgaatttttacatttatatacactcatgtagacacaacccaaattaaaataggacctttcactccagaatgtttcctcataatatttcccagttaatacgtacctgttcctactctcagaaataacgactgttcttacatctattaccgtaaatacgtttttcctattcctgaaatttatataaatggaatcatagagagtatggtctggtttcttttgttaaaagtatttgtttgatttatccatgtggttgtatgtatcagttaattcttttttattgttgtgtactattgtactgtgtgattgatttacctcaatttgcttctttcttttccttttgatggacatttgagttgtctctagcttttggcttttatcaataaacttcctttgaatattctcata

SEQ ID NO: 45520 - DNA, 687 bp, Homo sapiens
cagcctcccaaagtgccacaccactgcgcccagcctcaaataatgtctttaaatcagccccaaatccacggagccacaaggaaaataattacatcgagcagcagttaacagaatatcccaaaccccaaggtgtgacagagtaaggcctgtgcagctgcagcgtggcgctgagcaggaaggacgcgtggagatgccggctgtggcgaccgcgtgatttgaaggcacctgtgacttctgctcctgatggggcagaggcctcatgaacacgactgtggtctgtggcatgctcacattggagggagtgccaggaagttcccaggcccgggacggccgcgccttctgttggtccatgcagggctcctgcctgtcttttatgagtgtaatgtcagcggtagcttagctctgattttaagctcagctgtacctcagctctggtgtagtttagtggcttagccgtggcagggaggggatggggtcggcccagccccctccccaggagggctttcctgatctcccccatcagaacaaccccctctcagctcctaccacctgttctgtctgtcccaacatcgacctctccctcctgtctcacagctggctgtgggcctgtgagtgctcctggatggaatgtcccagatgccgtcggtcccaataaatgagcccgtagcatggcacccgatccaccca

SEQ ID NO: 45521 - DNA, 474 bp, Homo sapiens
gacataacgtatagccaggaattgggctgatataaaaatgaagaccataaaatcatctgtattacggatgggcacaaatttggcttcaagcttcttagcagccaacacaaataggggaatatgtttgaacacttacgtaattcagcatctataatagtgctgtgcaattgaaatataatgcaagccacttgggttattttaaatttccttgtagccacatttttttaaagaaaaaagtaggaagaagtggtgaagttaattttaatgataaattctgtttaacacagtgtatcaagaatattgtcattctaacatgtaatcagtataattaattattaatgagatatttacttgtttttcgtattgagctctcaaaatccaatgtgtgtgtgtgttttgtttttctttcctcttgtttgaacacccagagcacatcttagtttggcctggccaccttttaagtgctcggtagcc

SEQ ID NO: 45522 - DNA, 282 bp, Homo sapiens
actttatccccattggaaatcaacttctggagaacatttcagctttgtatgctcttcttggtcccactcaaatgggaagttctgctcgaggccagaaatagaaaacaggaagtcaacagaactgattttcctaactgcccaaatgcaaatcaccacactccgttatggatgagaattagagtaaaatgtaaacttctttttaaaaagaagttcacatgctaactgtgtacagaaaacatcctactccagggaagaaagaaagaaagaaagaaaggaaagatc

SEQ ID NO: 45523 - DNA, 838 bp, Homo sapiens
  misc_feature (694)..(694): n is a, c, g, or t
  misc_feature (698)..(698): n is a, c, g, or t
  misc_feature (716)..(716): n is a, c, g, or t
  misc_feature (736)..(736): n is a, c, g, or t
  misc_feature (745)..(745): n is a, c, g, or t
  misc_feature (767)..(767): n is a, c, g, or t
  misc_feature (774)..(774): n is a, c, g, or t
cggccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtggcaaatcgaggcacagagagggagggcgacttgcccccaggtcacacagctggatggagaagagggacgggagcgaggaggacttcacttagactgcngcangagagataccctgccganaccagccacacatggcggantcctggccnggagctcgacaggaagcaccanagctgancgacgagtgctgggtctggggcactggggtgacaaaacctcaagctggccgggaacctcagcac

SEQ ID NO: 45524 - DNA, 983 bp, Homo sapiens
  misc_feature (839)..(839): n is a, c, g, or t
  misc_feature (843)..(843): n is a, c, g, or t
  misc_feature (861)..(861): n is a, c, g, or t
  misc_feature (881)..(881): n is a, c, g, or t
  misc_feature (890)..(890): n is a, c, g, or t
  misc_feature (912)..(912): n is a, c, g, or t
  misc_feature (919)..(919): n is a, c, g, or t
cggccccctggcggcgcgctctacagctgggagaccggcgacgaccgcttcctcttcaggaatttccacaccggcatctggtactcgtgcgaggaggagctcagcgggcttggtgaaaaatgtcgcagcttcattgacctggccccggcatcggagaaaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcagttgaagactccacgctggttttccctcagcctcctgggccactctgcctcagctttctttgctggtccctcctgctctgcttaatatcagatgttggcttcatcctgggacccttctctctcctcttcctacagtctctctccaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtggcaaatcgaggcacagagagggagggcgacttgcccccaggtcacacagctggatggagaagagggacgggagcgaggaggacttcacttagactgcngcangagagataccctgccganaccagccacacatggcggantcctggccnggagctcgacaggaagcaccanagctgancgacgagtgctgggtctggggcactggggtgacaaaacctcaagctggccgggaacctcagcac

SEQ ID NO: 45525 - DNA, 721 bp, Homo sapiens
  misc_feature (577)..(577): n is a, c, g, or t
  misc_feature (581)..(581): n is a, c, g, or t
  misc_feature (599)..(599): n is a, c, g, or t
  misc_feature (619)..(619): n is a, c, g, or t
  misc_feature (628)..(628): n is a, c, g, or t
  misc_feature (650)..(650): n is a, c, g, or t
  misc_feature (657)..(657): n is a, c, g, or t
gcagctgagtcagtgagcagcgccatgatgaggggcagtccctgccagcaccaacaggggctggaaacccagcgataggagcatcagcatctccgaggggtcctgtggctgtctgtggtctccgaggtgctgtacattctgctgctggtggttggcttcagcctcatgtgtctcgagctcttccactccagcaatgtcatcgacgggctcaagctcaatgccttcgcggctgtcttcacggtgctctcaggcctcctgggaatggtcgcccacatgatgtacacgcaggtgttccaggtcaccgtgagcctcggtcctgaggactggagaccccattcctgggactacgggtggtccttctgcctggcgtggggctcctttacctgctgcatggcagcctctgtcaccacgctcaactcctacaccaagacggtcattgagttccggcacaagcgcaaggtctttgagcagggctaccgggaagagccgaccttcatagaccctgaggccatcaagtacttccgggagaggtatggagaagagggacgggagcgaggaggacttcacttagactgcngcangagagataccctgccganaccagccacacatggcggantcctggccnggagctcgacaggaagcaccanagctgancgacgagtgctgggtctggggcactggggtgacaaaacctcaagctggccgggaacctcagcac

SEQ ID NO: 45526 - DNA, 398 bp, Homo sapiens
acttcagattgcagatttgccaaagcttcatgtagagcccttctctcttttatcacgagtaaaagttcaggtttaaaatagaacaacggatgactaatgccatttccagctgtgactgaattctccactgcctgatgcttttcaaatgtatctgaatcagaatcgaacacccactttatgcatagctccctaatcaggaagttattcttcccatcaaagcaactggaaagaaaaaagataaaacaatgaagggaggagaaaacacaaaagttcaagaagagcagaatgttccggcaaggagaaaaagctgggaaaagtcaccaatgaatgccagggttcaccactatcttaggaatatcatgaataaagcgttagattgggtgtgccctaactgatgg

SEQ ID NO: 45527 - DNA, 779 bp, Homo sapiens
cagatattggactgtggttgtgccagttgacactcaggagtggagactagatctgcaatctgttgggactgtgatgaggggatcatcctgccctcgaaccagacccagccctgtagcccaggcactattgcctggagttcctgggctctcagcgccaggaaatcatgaggttcagtgtctcaggcatgaggaccgactaccccaggagtgtgctggctcctgcttatgtgtcagtctgtctcctcctcttgtgtccaagggaagtcatcgctcccgctggctcagaaccatggctgtgccagccggcacccaggtgtggagacaagatctacaaccccttggagcagtgctgttacaatgacgccatcgtgtccctgagcgagacccgccaatgtggtcccccctgcaccttctggccctgctttgagctctgctgtcttgattcctttggcctcacaaacgattttgttgtgaagctgaaggttcagggtgtgaattcccagtgccactcatctcccatctccagtaaatgtgaaagcagaagacgttttccctgagaagacatagaaagaaaatcaactttcactaaggcatctcagaaacataggctagggtaatatgtgtaccagtagagaagcctgaggaatttacaaaatgatgcagctccaagccattgtatggcccatgtgggagactgatgggacatggagaatgacagtagattatcaggaaataaataaagtggtttttccaatgtacacacctgtacccaatgtcgt

SEQ ID NO: 45528 - DNA, 135 bp, Homo sapiens
gagcaagtcaagcttggtatgttgctgacaggcaaaatcttacaattaagctgattaagtcttaaatcggtcagtttcccactttgatattagggtatttaacaggatataattttataagttgcttctttctaa

SEQ ID NO: 45529 - DNA, 3566 bp, Homo sapiens
  misc_feature (32)..(32): n is a, c, g, or t
  misc_feature (143)..(143): n is a, c, g, or t
  misc_feature (743)..(743): n is a, c, g, or t
  misc_feature (845)..(845): n is a, c, g, or t
  misc_feature (878)..(878): n is a, c, g, or t
  misc_feature (1194)..(1194): n is a, c, g, or t
  misc_feature (1915)..(1915): n is a, c, g, or t
  misc_feature (2333)..(2333): n is a, c, g, or t
  misc_feature (2850)..(2850): n is a, c, g, or t
tctagaattcagcggccgctgaattctagaantttttttcactaatgccttcttcctgttacaagatccaatctgggatcccacactggatttaattgttgggtcttcttagtagctatcctccaatctgtgacagtacctcngtctttctttcattgtcttataaaacatttttaatgaaaagagaagatgcttaatatatatgtagaggaaaaaaaaccaatgccattttatctctttttttatatttatgtatttatttattacctccattctctcagagtgggatattttatcttttaaaatgcttaagaacctgaataaaaatctttatttttctttaaaaagttacaaaagtattataaaaaattaaatggtgtagaaaacataaagaagtagcaacccagtagtatctcccagagataactaccattaacaatttgttgtgtatccttttatttatttatttttgcctagaatttatatgtatattatgagatcataatgggcatactgtcctgtaacttgtgtttttcattcaattgtatattacgttcacttaacatttttcaatgtcaatatatatagatctgtttcactgttttaaatagctactcagtatttcataatatggctgtattatttcatgaagccattctcttattgatggacctttaggttatttcagttttcatacttatacaagatgctgcagtaaatatccttatatatgtactttagcnaccagggcagtaatttctatgaggtgaaattgctgggtcagagacatatccattttctacttttgcagttattaccaaatttccctccaaaagactgtatcnacttatctgcacatacgcatcctagtttcagtnacgtatttctgaaaaaataacaggacgtatttccagacacatggatgacaaagggatagaacattaggaatctagaccctcctaaaaagtgtaggttatgtaagtctcctccccaaagcattactgtaattatttgtgacaaataatgatccatgtgaatattaaggatgtttgatatactatcagctgcctctttcctatgtggatgagctgtaataaagtgacagcttaagaactcggccttttcaggtgtgtgttagattttctctctcttccttagccctaacttctaacagaggaggtagaattagtgcancaaaaataataataataacaagataacctttgtttttatatataatataatattttaaagggttttgaagaacagcctgacatgtgaaatttgaatatggttcaaggctgttccaactaaaataaggttttcatttttcttgttaataaagaaaatcagtatgtatttgtgcatatgtatgatttattcacatacacattatctctgtaaaatatgtacatgcaagtcattaacaattttttaaaactacagagactatcattttctgattaactagtttgctagttaaaatgagggcaaagaagtcccatttacactaatgtttagaaaattcaacatgatgaataattacagaggcaatctcctaaaagcccaaattagaaaactgttacaaggcacagcccttctaaaatggggctgtgatttgggaactgttcctccctcagtcatttaaactattttaataattgtattctgctgctagagaattggaaggctgtcagttccctttatttgaatgcttactatgtgccagagactgtgctgtacacttgacatgtatcatttcacttggttgtcatagaaactgtggatggaggtagtgccacttgaaaactgagctttggagagagaaaaaaagatttttcccaagatcatgtgggaagtgagtggtggcacccagacttgaacttcaaagccttgctgcttttacccagcatanttaagtcaaagtctgaaatctgtttccttattgctttttctttttctttttttttaaatgcggtcttgctctgtcacccaggctggagtgcagaggcccaatcatagtttactgcagcctcgaactcctgggttcaggcgaccctcctgcctcagcctcccaagtaattggaattacaggcatgaatcagcctgcttggtccgttattgcttaactgtaacatggaccaaagaagcagctaaccctgttagttaattcttactaggaagagaaaccgcaccagctatttaaaaaaaaaaaaaagcaaaacaaaaatgaaaataccaaggtatactggaaaataacattgagcttagaaggagacctgagtttgtacctggctcagtcacccagctcatttatcactttcttaggaagncctttccctgtcacaccctccttcttgtttgtctctattagagcactgaactcattgccataattaccttattgcagtgattctaaggtggacatctttcacattttaacttttctaaagtgtggatgcattttacaattgatggtgttttaaaataaattggcagcattttttcttaattattggtacttaaaataaggatgtgctgtacagttgatgacatcttagatttgattaagtgcatatttatttttgtgtgttcccacaaaaatgtttacatcattctcatggttttaaatatcagatatatgcaatgattttccaatttctatccttttttaaggtccacccctgtatgttgaaccacattgtttcttcatatcacaaggattacagattcaacatatctactctccaaatcagtttgtcttctattgttctctatctcagtgaatggcatccacattcgtacatttgtggaactaaaacatgagatgatcgcccacctgggtttgancttaactattcacttgtaaaatggggaacataataacacctatctctgaggattgttagaatgactaagacattgaataaatgttagctgtccctaatcttcatcatacatatctatgacttctctccttcctctgcacatgtaattcatcaactcctgtgatagataggcccttcagagtatctcacatctaccacttctatcttgttgccacttctccaatctaagcccccatttttcttgcctatgcagcaactaatattgtagcttctcctctttcccatgtctaatccagtcacaaccatccattaaatcagaacatgccacttcttaagacctccctcaccccctacctaatgcatttggtataaaacaccacatcattaatgtggtctgtatggttgtctgtttcctgcctggcttctgcccacatttccagcctcatcctctgccactctgcctcccagtatcactcttttcctccaaaagtaactcctactcatcctttagatttcagcttaaatgtcacttcctcagagatgattattgatcttccaaactaaattaagttcttcagttatagtcctttatattgaatgtatgcctttcttctttgggatgatcagtttctcccaaactgtggctaaagaagtgaagtaacttccacaaggccaaagagtgagatctattagaactggaattctctctgttagagg

SEQ ID NO: 45530 - DNA, 3617 bp, Homo sapiens
  misc_feature (32)..(32): n is a, c, g, or t
  misc_feature (143)..(143): n is a, c, g, or t
  misc_feature (743)..(743): n is a, c, g, or t
  misc_feature (845)..(845): n is a, c, g, or t
  misc_feature (878)..(878): n is a, c, g, or t
  misc_feature (1194)..(1194): n is a, c, g, or t
  misc_feature (1915)..(1915): n is a, c, g, or t
  misc_feature (2333)..(2333): n is a, c, g, or t
  misc_feature (2850)..(2850): n is a, c, g, or t
tctagaattcagcggccgctgaattctagaantttttttcactaatgccttcttcctgttacaagatccaatctgggatcccacactggatttaattgttgggtcttcttagtagctatcctccaatctgtgacagtacctcngtctttctttcattgtcttataaaacatttttaatgaaaagagaagatgcttaatatatatgtagaggaaaaaaaaccaatgccattttatctctttttttatatttatgtatttatttattacctccattctctcagagtgggatattttatcttttaaaatgcttaagaacctgaataaaaatctttatttttctttaaaaagttacaaaagtattataaaaaattaaatggtgtagaaaacataaagaagtagcaacccagtagtatctcccagagataactaccattaacaatttgttgtgtatccttttatttatttatttttgcctagaatttatatgtatattatgagatcataatgggcatactgtcctgtaacttgtgtttttcattcaattgtatattacgttcacttaacatttttcaatgtcaatatatatagatctgtttcactgttttaaatagctactcagtatttcataatatggctgtattatttcatgaagccattctcttattgatggacctttaggttatttcagttttcatacttatacaagatgctgcagtaaatatccttatatatgtactttagcnaccagggcagtaatttctatgaggtgaaattgctgggtcagagacatatccattttctacttttgcagttattaccaaatttccctccaaaagactgtatcnacttatctgcacatacgcatcctagtttcagtnacgtatttctgaaaaaataacaggacgtatttccagacacatggatgacaaagggatagaacattaggaatctagaccctcctaaaaagtgtaggttatgtaagtctcctccccaaagcattactgtaattatttgtgacaaataatgatccatgtgaatattaaggatgtttgatatactatcagctgcctctttcctatgtggatgagctgtaataaagtgacagcttaagaactcggccttttcaggtgtgtgttagattttctctctcttccttagccctaacttctaacagaggaggtagaattagtgcancaaaaataataataataacaagataacctttgtttttatatataatataatattttaaagggttttgaagaacagcctgacatgtgaaatttgaatatggttcaaggctgttccaactaaaataaggttttcatttttcttgttaataaagaaaatcagtatgtatttgtgcatatgtatgatttattcacatacacattatctctgtaaaatatgtacatgcaagtcattaacaattttttaaaactacagagactatcattttctgattaactagtttgctagttaaaatgagggcaaagaagtcccatttacactaatgtttagaaaattcaacatgatgaataattacagaggcaatctcctaaaagcccaaattagaaaactgttacaaggcacagcccttctaaaatggggctgtgatttgggaactgttcctccctcagtcatttaaactattttaataattgtattctgctgctagagaattggaaggctgtcagttccctttatttgaatgcttactatgtgccagagactgtgctgtacacttgacatgtatcatttcacttggttgtcatagaaactgtggatggaggtagtgccacttgaaaactgagctttggagagagaaaaaaagatttttcccaagatcatgtgggaagtgagtggtggcacccagacttgaacttcaaagccttgctgcttttacccagcatanttaagtcaaagtctgaaatctgtttccttattgctttttctttttctttttttttaaatgcggtcttgctctgtcacccaggctggagtgcagaggcccaatcatagtttactgcagcctcgaactcctgggttcaggcgaccctcctgcctcagcctcccaagtaattggaattacaggcatgaatcagcctgcttggtccgttattgcttaactgtaacatggaccaaagaagcagctaaccctgttagttaattcttactaggaagagaaaccgcaccagctatttaaaaaaaaaaaaaagcaaaacaaaaatgaaaataccaaggtatactggaaaataacattgagcttagaaggagacctgagtttgtacctggctcagtcacccagctcatttatcactttcttaggaagncctttccctgtcacaccctccttcttgtttgtctctattagagcactgaactcattgccataattaccttattgcagtgattctaaggtggacatctttcacattttaacttttctaaagtgtggatgcattttacaattgatggtgttttaaaataaattggcagcattttttcttaattattggtacttaaaataaggatgtgctgtacagttgatgacatcttagatttgattaagtgcatatttatttttgtgtgttcccacaaaaatgtttacatcattctcatggttttaaatatcagatatatgcaatgattttccaatttctatccttttttaaggtccacccctgtatgttgaaccacattgtttcttcatatcacaaggattacagattcaacatatctactctccaaatcagtttgtcttctattgttctctatctcagtgaatggcatccacattcgtacatttgtggaactaaaacatgagatgatcgcccacctgggtttgantcccagttccgccctatagtagttactcaagcatgcagtgaagtatgtcaccttaactattcacttgtaaaatggggaacataataacacctatctctgaggattgttagaatgactaagacattgaataaatgttagctgtccctaatcttcatcatacatatctatgacttctctccttcctctgcacatgtaattcatcaactcctgtgatagataggcccttcagagtatctcacatctaccacttctatcttgttgccacttctccaatctaagcccccatttttcttgcctatgcagcaactaatattgtagcttctcctctttcccatgtctaatccagtcacaaccatccattaaatcagaacatgccacttcttaagacctccctcaccccctacctaatgcatttggtataaaacaccacatcattaatgtggtctgtatggttgtctgtttcctgcctggcttctgcccacatttccagcctcatcctctgccactctgcctcccagtatcactcttttcctccaaaagtaactcctactcatcctttagatttcagcttaaatgtcacttcctcagagatgattattgatcttccaaactaaattaagttcttcagttatagtcctttatattgaatgtatgcctttcttctttgggatgatcagtttctcccaaactgtggctaaagaagtgaagtaacttccacaaggccaaagagtgagatctattagaactggaattctctctgttagagg

SEQ ID NO: 45531 - DNA, 387 bp, Homo sapiens
cgtgatcttggctcattgcaacctctgtctcccaggttcaggcaattcccctgcctcagtctcctgagtagctgggactacaggcatgtgcaccatgcctggctaattttgtatttttttttaagtagagacagagtttctccatgttggtcaggctggtctcgaactcccaacctcaagtgatccgctcaccttggcctcccaaactgctaggattacagccataagcctggcctaaaattttaataaaaaataataattgctcatagtaaaaatttgaagagttaagaagataataagaaaagccacttcttgacctcctcttcttctaggcctactccctgatgctgaagaccactgtttataatctctcaagtcttctttcaa

SEQ ID NO: 45532 - DNA, 176 bp, Homo sapiens
tatttgaattatctttccttctttaagtaaatattttttcattttaatttccactttaatttaaaaaaattgatttgttacacagaacacttttttaaaaatcttaatttatctttttttcagattcattgaagtataattgacaaataaaaattatatatatttaagatatacaa

SEQ ID NO: 45533 - DNA, 1215 bp, Homo sapiens
gagatgatggggagatatgtaaggagttaccatttggccagactctgaataaaacacaagagccatgtgtgggaagtggagcataaccaaactgcagcaatagttctgtttgtaaagtccttttatcaccttaattgaatgggactgtcctgtggcctcagggctacctaggatgcaaataaaatcacccactattggctttgtggtatcctgagataccacagcacaagaaaggggcttgagatccgcagagatcattctccgctatccaagctctgaaacccttcagtctgaaggctgaaaaacactgattcattgtagttcaagtctcacctgatagcaccactcttgagtctgcagtctcaatttccacatctgtaaattgggaaagatacccaacttgcaaggttattgtgacaaccataaagagtatgtatcaggtgcctgacacgtactaagtgtttaataaacagtaaccagtattactccccatgagggttagcttattaacatctcatttctaagatgttagaaatgatcctcagattccttagaacctaaggtagacagtttcagccttatgatattactaagatacataataacaatttagagttcccatacataaaagattgttctacccattgcctaccctcaccctccaacttagctcattactccctccagagaatagtagttgggaggtagggatgagagtggataggccctgaaaaggcagtttaggggtgtcagtgtaaaatgtgcacagatacatattgtgtgaagtcagctgcacgacagccaaataattttatgcatttttatgtatccactcttatccatcctgtaaacctagtttcattcacaaaggtgaacacatttagtttcttcaaatacatgagagactggctgggaataatccccccaggagttaccaaaagaggtttcaacatttgaaggccaccctgagccatgggaacaatggagaggactcactgtgtgactctagtctgtctcccttgcccctgagaggagataacacctcctcttctctcagttctgtacagctcagccttgaccttgaggttcctgggaagttgttagaattgtgttaggttagtacgaaatctattcattcctaagctgatcagatcccatttcctgacttcttgtcattgaatacttcacatttagtttactctgaaatgtacgtta

SEQ ID NO: 45534 - DNA, 434 bp, Homo sapiens
catagtgcttggctcaaagtaggcattcagcatattcatttaaatttgaaatgaatgtagaaaggaatgggttgtgcaaatcatatacccttgcaggaggattaaggccagcatgagcctccgaaacagaggggttgataccattggttctactgaaatataaacataaatgaatttgattttcaaattcattttctgagaatagagcatctatcttttatccggaatctactgcatgaacggctgccatggctcacacaatgactaagaaggttgttctagcaaagatgaaaactggaagctacaaccagtctaaagtctcaagtggatgcaaggtgagcctctccaatgggcagctgggactccagagagccatggctttcctgaccttaacttcccagctttgctcatgtctctagaaatgtagaaatatc

SEQ ID NO: 45535 - DNA, 195 bp, Homo sapiens
agcatctcaatggaagcagggaaaacaacagaaatatcatatctgccaagttctagtcatctgttatgttacatagtaatttgtcatctcatgagatcaccaaggagagaaaaaagccatgccgtgctacaaaataaactctgtaaagcaggtagtttaatagcaaattaatgatgtgctgacaagatcaagacc

SEQ ID NO: 45536 - DNA, 526 bp, Homo sapiens
tgtgctccatcctggatgacagtgagaccctgtcttaaagcaacaacaaaggaacaaactacacagcaacctggatgggcctccagagaattatgttgagtgaaaaaagccgttcctaaaggtttcacactgtatgttcctttctgtaacatctttgaaatgacacagttgctgaggtggagaacagattagggtttgctaggggtggagagaagtaggtgtgcctataaagggcaacaggaggggtcctcacagtgatgggtgctctggctgtgtttacatccatgtcctggtgtgatgtgctgtagttctgcaagatgtcactgctgggggcaatagggtaaagggagcgatggatctccctgtatcatttcttataataagagaatttacaattaccttaaaataaaagtttaattataaagaaattgcaatttgactactacttggcatgtcagtgagagaatgtagataataaaatgatgtaaaaactaagtaatgattaagaaaaattatctaagttgta

SEQ ID NO: 45537 - DNA, 392 bp, Homo sapiens
tacttttagcatgagcctttccctgacctcttcaggacagccacccttgatttcctccccatgcaccttacatctagtacagcaagctgccgccaaccctgtgcacagacctctggcattgcacctaccaggccgttctgttcctgtcttctatttgactcccctcagcctgagcagatgcaggtgagtgattctgaaccttcagatccttatgtctacagagaaactggtacctagtaagtggtcaatacattttggctccgtgaataaataagtgaatattcgattctcttctgactgctggggatggccttatctgacagctaacgtctaaacaagtttcctagagtgattaacacaagcaggcaaggatgaaagaaagaaatgcaaaa

SEQ ID NO: 45538 - DNA, 409 bp, Homo sapiens
tgatcaactcattatatttgactctaaagtgtctttctgcatgtgaagtatcatcatctagagagttactctcaaactcacttctttctcccttccacccagctcatcaacagaccgcctaacccagaaattaaatctgttgacaaatttgcctgtattgtctgtgccagtctatctatcttgtcatttatgcagccaagtaagaattgggtgggtatataagaggagcattaaaatttgatgtggattttattgagattcttcataatctttatattctttggcacagggcctacctatgtcctctggaaactagaaatgaaaaccagtatttattcaatgtagtattaattataattttaaaaactggaacaacccaaatatcagaaatacatgtatagtgtgtagg

SEQ ID NO: 45539 - DNA, 331 bp, Homo sapiens
aagaataaaaggtggattccatgtattccatagtatattgaagagagaatggaaaattatggtgaaatggtacaggcatactctaagaagtaaaaccagcacttagaaaccttaggaaaaataaagtactaaatgacaaagttacagtccaaatatgatgcacactaaaatgtgggataattccaaataactagcagagtataagaaaagataatttgatgcttgagtcattttcatttaaggggtaaaaaccaacaaaacaaaacccagtgacataaattacagctcctttgcttggcatttgatcattcatttggttctttgttgagct

SEQ ID NO: 45540 - DNA, 287 bp, Homo sapiens
ctctttagaaactattttttctattaaaatgtacatactcagaatactatcattattaatttaacagtgatttaaatataatagttatgtggaaaaatattacatttattattttcttccctcagtataacactgtattagatactgatcataacaaccagaacctttgtcatggcaatcttattcattcatttactcatccatcaaacagttccttagaaattgttccataccaggctttggaaagtttcctctgaaagaaaactctattatctagcaaagaacca

SEQ ID NO: 45541 - DNA, 310 bp, Homo sapiens
tccatcttacacaaacctgagctggaagctcaactggatttgttccctgtttgaaatattgtgatctccctcccatgaaagaaaaaccaagaaccagaggcgtagactgactgaagacacaactcctggctttctgaagctatggacttggattggattgctgggggtttgtagagaaaggtgacaaatttcagtacctctggcatgctgtcccaggaaactagggctcccactaacttatgaggtttttaaacacattgaaaatgacatgacattaaaataaatttggatttgctcatttaaaaaaaaa

SEQ ID NO: 45542 - DNA, 626 bp, Homo sapiens
gatctgtttaaaaaagaatgtgcattcctgaatcaagagtttatgaatagcttaaagatgaagaggagagatgaaggaggattagctgttcaccagaagttctggttattctggttattggatctgaaagcatattattaaagtatcgtctagatttcctggaatagttctcatttctaatattctttcccattgtttttataatacatgtctgatttgccctaatttttggttagttgaggtgtggttgatttgtaaaagaacaccaaaagtgggtctacttgactgaagaagctctcttgctttccaactttgtgtttgtgtatgtgtgtgttaaatgtatgttttctaatctatctcttttaacctaaactttgattttaaagtccacattagagaaagagcaatagagacagactgactccactttagaaaattggtcaagaagtggaccaggtgggaatggttacttaatcctagcagaggaataaagtacttgatttccagctacctactgaatgcactctgctactagacagctattcttatttttttttttttgacatattatttccataggggaactttatagttcaattcagtaaccttggagagagatcctgacc

SEQ ID NO: 45543 - DNA, 526 bp, Homo sapiens
aagacagagttttactcttgttgcccaggctagagtgcaatggccgttctcagctcaccgcaacctccatctcccaggtttaagcaactctcctgcctcagcctccctagtagccgggattataggcaagcgccaccacgcctggccaaaaattttatttttggcttacagtcctgaaatgttcttttatatttgcattgcctgtgcttttagttactggtatagcttgcgtaaaattgtacccttgctaaaagaaattaaaaaatcaaatcatttattaaaatctttgtttggtgagagagacaaggtcttgctctgttgcccaggctggagtgcagtagccctgttataactcactgcagcctcgaactccttggctcaagtgatcctttgcctcagcctcccaagtagctgagattacagctgccggccaccacacctggttaatttttttttttttttaaagattgagggtgatggccatgttctcactatattgcccaggctagtcttgaactcaagcgat

SEQ ID NO: 45544 - DNA, 465 bp, Homo sapiens
gcagggcgcaggttggagtgaatggttatccttgattacccaggtgggccctgtctaatcacaggagtctgagaacgtgacattgagaaccttttaggttaggtcagagagagataaggaagatagagagagagagagagagagagagagagagagagagagatgaaatgagcaggattttgcgacctgctgaagcctttaatggggaggtaaggagactcaagccaaggaaggtgggcagcctctagaagctggaaaagtggagaaagaagaattctccccaaagcctccgtaaggaaacacagccctgccaactccttgatttcagtccagtgaaagttgtgtgggatttctgccctccatatctggcacataagttatctatatctatcttaggatatagagtaggtgcttaatgcatacttgtttaatggaaaaaagtgaataaaaataacagttggatta

SEQ ID NO: 45545 - DNA, 1780 bp, Homo sapiens
agacggggtttcaccatgttagccaggatggtctcgatctcctgacctcgtgatccgcccacttcggcctcccaaagtgctgggattacaggcatgagccactgcgcccggcctactctacactttttttaaccctaagaattaccactacagtaatgtagtggagtgggaagagtgcctggaatcagaagaccctgttgaggctgaatttagctgtatgacctcatgcaagccatttaaactctgtgcctcagcgtcctcatttttaaaaggaggtttgatctctatgtttacttccagctctgattctgggattctaatccacaggacttgggtgttagggtggaacctagaactgtgctgtccagtgcagtagccactagccacatgtggctactgagcacttgcaatgtggctagtacaaagtgagatgtgctatcaatgtaagatacataccagattttgaagactagtattaccaaaagaatgtaaaatatcacattaataattttatattaattacatgttcaaatgatattttggatatactgaattaaaacattaaaattagttctacttgtatctttttacttttttaatgtggctagaagaaaataaaattatacatgtggctcagattatatttctattggacagcgctgctctagaacattatattaagtggttattattgaagtagaccaaagtttataccataaggatatttttccttaaataccatgtttgaagaacaattatttattgatccttgaatctgtaagatcaaataacaagtctctatccatgttaccaaatttaaacttttgaaaataataaactttaaaatatcagatgtgttattacaggatgatacttggaatcaagtgaaatgagttatatggtcatcactaaatttagaaatctattgtgaaacaaagacaaacaggaaagtacagaatagagacttttagtaaataaatggaatttaaaagaaagtgtttatttacagtgtcacgacagaaaaggatgtctttgttgtcatagtctttgagggatctccgtaaaatctggggcacaggtacaagaaatagccaatatttagttcccagaccatgtttagtagtgtccagtttcagatcatgctgccaagaggtatctccccctcaggtgggtcatcactgagccctggaattggagactcatacttgcccagcacaatgttacgggcagacaggccgacatctatgattagctagaagccataaagaaaagctgctaagtggccactaggtgccacttttctgtttttgtaatgctttcattagcagatcttttttttccaagctccatggggcctatgagaggcatttatgatttttgtgcctacaataagtcagcctgtctggtgtgagttgttttatgagaaatgctttccaagggaggtctaggaagatcctgacacataagaactttggcttagagagctttccaggtgtagtgccaataaaaactgacctggaaagaaaacctgcccagcacggaacatgctttctgaactcacttgagagtgtatggtgtatgtcacttctcatatattcttgagtttagatttgtcttttatacaatttttagctcttttccagttcacttgtgctcgtctgtatattggtatttttaaatttttgtggtaaataatgaaaagagtgaaattatattttataattactcatttgtagtttttttttttaatttaataaacttcctccaaaaagtgaaaaat

SEQ ID NO: 45546 - DNA, 305 bp, Homo sapiens
aagtgtccttaataaattttatcaatgatgtgactgaaattcatgaactcaagtctaaaatgatactgtaatattgggacatgtgttggagacactctgactctcggaatagagaatcccattctcctaacaagttaaaaaatatcattgaaagcatttgccaaaatcccttgtcagcttggctgcttccattaatatattagatgccattagcacctgagtgtgaatgtgccagtgcgtcagatgggctctcctgacctggctaggctctgagtttcacttttagagaagaggtggggctagtg

SEQ ID NO: 45547 - DNA, 663 bp, Homo sapiens
gagtgtacatttttaaagggtcatctctctctctctctctctctctcacacacacacacacacacacacacacacacacacacacacagaatatgctgcagagatcatatgtgacctgacaagcctaaaatactcactatctggtcctttataggaaatgcttactgacctctggtctaaacactgagaggtaagggacctctgctgcaccgccctggagggatttttgatccctaaataagaagaggtgaggaggaagcctgcccttcctcctggcctgaatgtgcttctgagaggcagtcaagcctggaactgtggcagccggcttgtgaccatgaagaaaccagcccaagaagaaaggccaacctgccaaggagggaacaggagcctggggcctcgaggactttgctgagccttcgtgtgaccctggagccaccttcctctggagttcttgtgatggcagataattcaatgttgtcattgttcaagccaggggtgggcgaactttttccataaagggccacatggaaaacattttaggctctgtgtgggccatgagatctctgttggcactacaaccctaaaaacaaccatagacaatgtgtaaatgaatgggtacacctatgttccaataaaactttataaaaatagatggtgggctga

SEQ ID NO: 45548 - DNA, 344 bp, Homo sapiens
gctcatgcctgtaatcccaacattttgggaggctgaggcaggtggactgcttgagcccaggagttcgagaccaacctgggtaacatagcaaaatcccgtctctacaaaaattagcagggcattgtggcatgtgcctgtaatcccagctactgaggaggctgagatgggaggaacacctgagcccagggagcttgagtctacagtaagccatgacagtgccactctcctactgcagcttgggtgacagagcaagccctgtctcaagcgctctgaactctgcagaggtccaagtctgaacccttaactaccactaattagtcatgagactgagagaatcactacat

SEQ ID NO: 45549 - DNA, 324 bp, Homo sapiens
gaagtaggtaggcagcagcttcctactcctgagggctgaggctggtctctctcatacattcaaggctgggaaagagagaggccaagcaggcctgcctgctcggagtctccccagggtggagcactccagggggatctgtggaggctttcacctggaggtggtgctggagggaaccaagctggggaatcaaacagaatggagagagaaatcgtggctgcagaggcacagagtccttgctacttagcctctcccagaacagcacgtgggctccaggaaggcagagacttgcaaaaggctggcatcatctcggagctttctcccttc

SEQ ID NO: 45550 - DNA, 425 bp, Homo sapiens
tgacctcccccctcccacatgactttactgctctgagcgccttatgttgacatagcatttgcatgtgtttcaacagattctccttgtcagtaaccttatcagaaagtttagtgagccttttaatttcataccctctttgaacaatattgtgaaataggatttttcttttatcgttttgatctacacactctctggatagagtaggattggtagaacccctaaagaaagcagcctggaatttttgcaatcttgtgctcattttttcccttgtaagtagcgcataatctgtagggtaggatggtaaagcttttattgctcctataatgtggtctctaatgaaggacttaaaacacaagaaaagtaccttaggattacaggcatgagctaccacccccagccacaactctgcctttaaaaaaaaaaaa

SEQ ID NO: 45551 - DNA, 1143 bp, Homo sapiens
  misc_feature (1097)..(1097): n is a, c, g, or t
ttggctgtctctccactctgtactatgaaaattggactttttgactagatacttaaataaaatgtaaataattactggactctaagtggaagcaattattttagcacatgaaattttcggttctgtatacttaaaggaaatcctgtgacaagaatcatattccagatatattgtttagcttttcctttatgtgactgatgttagaaattgagtatgttcttaacatttagaaaggagtttgcagaaatatgcccatacagtgaatattattgtttacaaattgtctgttgaaagatgatttaaaaacagttagaaacaagctagttgccatagctgtttttcctaccttgatcatttttatcctgttgtcttagaaaaattagaaaaaatatattactgacacaagtggataatggcttcaaagtacatcacggacatttttacctttaaatagtataaatgacttgaagtcagttttgctcttttaagatcgtgcaatttttatttatttggggagttttatttgtttattgtgggttgatttgtgatgtttcatccactgtcacatggctaacatcactgtttcatagagcattggtagttcatttggagcatttcattggttcacttgttacatttggttggtacagttatacatcatgtttaacatctgtccagttaatatggcttttctagactttatgtggaaacatttgacaaataaggtaactgaaaacaaatagtttgatttagagatacttgccatttcctgtgttcagtaaattttgttggtaacaaatgcatattttataaattgtaaatgttttatacataagttgaaatggttgatatatgcttgctaattaaatgctcttgtgcctggtcttggtggcacttgcctcaaggattgcttgagtctgggcattctgggctgtagtgtactaagccgatctggtatccacactaagtttgggcatcagtatggtccagggctgcataaggaggggtgaaccggcccataccagaaccagagcaggtcagaactcctgtggctgatccagtagtggggatccgtggcctgtggaatagggcactgncattttcagcccgggcaacatattcaaggacccctatctgttaaaa

SEQ ID NO: 45552 - DNA, 368 bp, Homo sapiens
  misc_feature (174)..(174): n is a, c, g, or t
  misc_feature (363)..(363): n is a, c, g, or t
aattattaaattgacacatcacttttttttgcagtagtaacgttttgttaaaatgagcgaatttgttatcacattctcagctttcaggaaggtgagctgagacaaagcaatgcttagcatttttctgaaacctttggatgcagtcaggacaagagagaggtgattgtgcccagnctttatcacctctggccaggtttctagtgtttgtgtgtgtgtgtgtgtgttgtatttaattgaatgattgctttggacattttctgttttgggggcaaaagtgtttatagtgaagatgggctgggctcagtggctcataccttcagtcccaacactttgggaggctgaggcaggaggatcgctggaganccagg

SEQ ID NO: 45553 - DNA, 1131 bp, Homo sapiens
  misc_feature (5)..(6): n is a, c, g, or t
  misc_feature (8)..(8): n is a, c, g, or t
taagnntnggtatcagtccggacggaagcaggaagcgggagcgtagggccacgcctgcggcgctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagctaaataacgactaggaaaaatttttttaaaaaaagaaaaatcagtttaatgtgggaagtacttaagtggtattatattttacattttcaagtatagtgcataaagaatgttttaaatgtaactgttttcatggatttcaattagacatgcctataataaactaagtatgtggcttattccatgtaattatttttgtaatataatacaatgtgtcttgta

SEQ ID NO: 45554 - DNA, 1081 bp, Homo sapiens
  misc_feature (5)..(6): n is a, c, g, or t
  misc_feature (8)..(8): n is a, c, g, or t
taagnntnggtatcagtccggacggaagcaggaagcgggagcgtagggccacgcctgcggcgctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagtaatagatagcaaattttaacaagaaaatcgtcacgggagactatgatatttcacttcagtttggcagagttatgacgttcgggtcaagagctataaagttgggtaaaaaacgctttggggaaaagaggggtgtgccttaaggtgctttttgttttttttttttagaact

SEQ ID NO: 45555 - DNA, 1906 bp, Homo sapiens
ttagaattaaccataattttgccacattacattatttcaaaaacactgaaatgaaatagaatttctagaacttgtgatgtttttatcttttgctatctatcaaggctactttttatacccattagtagtaacctaatgataccttgttctgaagtgattatatatttttggcctcaattataaaattcgaaagtagagttagttttcagtttttgttttttgttttttaaataatgaatgattcagtttagttgaatgataaggatttctttagggtacagaaaaaggcaggtggcctgctcttggtaaaatataggtattgatctaggcagtatgtttaattaaatcttcaggatactgaagataatttctgggggaagtgtcagaaattctaagtaacagttttatactgtttagaaataattggccagaatgtctctgttatatttaagttacctaggtgtatttagtaaagtggtatatcaagccgcctcttctttttaaagcagtggaatggtttgtaaaaggatcttggggtcgtcagggctggggctcttgtgcttgtagttctcctttcctttcccctgaagctcctccacagaggaggaggggctttgccaagcagcagggctgacctagagtggaggctgcatcgtggaaggatccgcctatgtcacccaggcccgaacccctggatctcatttagttttttcttttgtcaagagttgccttaccatacaagctgctgtaaggatcaaaaaggtaataaatagcatgaacgaattttgaaaagtgcaaatgctaaacacatgtaaagtggtatggcttgtgaagcgtgcttgggtttatcagtgatcattacttgattttatgagctgttcgtattatcagaagtaatgaaatcagatgatctgtacttgtgtaaatgagggaatattaattcccctggttcctacactgagttttgtctaaacaaggccgtgtgcagttatatatacctaacctttattcccccatacctttcagaaagctgtgagaataggtgtcagtcatgagaatgctaattgaaatatatcgtgtttccagatatatagatcaaggtcgaaatccccagctctacaccaaagagtgcctggagagggctctagctaaaaatgagcaagttaaaggcaagatcgacaccatgaaggtaagactctaaggagtgtcagaaatacagtgggaagagatgccttctcagtggaatttggttaagagactcatttttttccatacttgctagaatattgactttcataacttcacatattgagatttctgaattgtgtaataggcagtaagtaaaattagatatcagctgcgtaatagcataaaaaacatacactaatcttactcttaaggaaatccagagtaatttttgtgatagtagttctcactggctgtgatcattttcatttttttaagatgcacttttattgcattgatactttctatttctgtagtaattcctactgttgaaggctttccctgtagtcatggttctttggtttagaggattcttgaatattgatttttctctttgtccagcttctgacctccaaacttctttttaccatatccactgtcatgaaattccccagatcacttagtttttctttgccttgatgagatgtagagaactctctgcacttgaacatgaaatatgtaattttttcttaaattgactcaaatgtagttcaaattggtgttttgtttctttatttggacttaacggccactcatttctgttggcgccatgcgactgttgccgtgtgcagcagggacctctgccttcctctcctcccagctcacaataggtgcctcttcctcctcccggccatccacgccggcctggttttcggttctg

SEQ ID NO: 45556 - DNA, 663 bp, Homo sapiens
  misc_feature (5)..(6): n is a, c, g, or t
  misc_feature (8)..(8): n is a, c, g, or t
taagnntnggtatcagtccggacggaagcaggaagcgggagcgtagggccacgcctgcggcgctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgagtaagtaacattcttgatattagtcttgggtataaatcttgttcagttatggtgtggtatcgtgacttcttcatcactggcattcgagtgcctgctgtgtggtaggcacagcctgggtgctggggatgtgccagtggaaaaaaaaatagacaaaaatacaaaaatacctgcccttatggaacttccgttctaatggcattacaaaacgaaaaaaaagaatatccttaatattctattgtggaaaaaaagttacatgtaaataaaagcttattaaatatatgaaatacatcataggtcctcaaagccctgcttaggctaaagaacagccacaaaactttcttttttccttaagag

SEQ ID NO: 45557 - DNA, 1908 bp, Homo sapiens
ttagaattaaccataattttgccacattacattatttcaaaaacactgaaatgaaatagaatttctagaacttgtgatgtttttatcttttgctatctatcaaggctactttttatacccattagtagtaacctaatgataccttgttctgaagtgattatatatttttggcctcaattataaaattcgaaagtagagttagttttcagtttttgttttttgttttttaaataatgaatgattcagtttagttgaatgataaggatttctttagggtacagaaaaaggcaggtggcctgctcttggtaaaatataggtattgatctaggcagtatgtttaattaaatcttcaggatactgaagataatttctgggggaagtgtcagaaattctaagtaacagttttatactgtttagaaataattggccagaatgtctctgttatatttaagttacctaggtgtatttagtaaagtggtatatcaagccgcctcttctttttaaagcagtggaatggtttgtaaaaggatcttggggtcgtcagggctggggctcttgtgcttgtagttctcctttcctttcccctgaagctcctccacagaggaggaggggctttgccaagcagcagggctgacctagagtggaggctgcatcgtggaaggatccgcctatgtcacccaggcccgaacccctggatctcatttagttttttcttttgtcaagagttgccttaccatacaagctgctgtaaggatcaaaaaggtaataaatagcatgaacgaattttgaaaagtgcaaatgctaaacacatgtaaagtggtatggcttgtgaagcgtgcttgggtttatcagtgatcattacttgattttatgagctgttcgtattatcagaagtaatgaaatcagatgatctgtacttgtgtaaatgagggaatattaattcccctggttcctacactgagttttgtctaaacaaggccgtgtgcagttatatatacctaacctttattcccccatacctttcagaaagctgtgagaataggtgtcagtcatgagaatgctaattgaaatatatcgtgtttccagatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagctaaataacgactaggaaaaatttttttaaaaaaagaaaaatcagtttaatgtgggaagtacttaagtggtattatattttacattttcaagtatagtgcataaagaatgttttaaatgtaactgttttcatggatttcaattagacatgcctataataaactaagtatgtggcttattccatgtaattatttttgtaatataatacaatgtgtcttgta

SEQ ID NO: 45558 - DNA, 851 bp, Homo sapiens
  misc_feature (5)..(6): n is a, c, g, or t
  misc_feature (8)..(8): n is a, c, g, or t
taagnntnggtatcagtccggacggaagcaggaagcgggagcgtagggccacgcctgcggcgctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattc

SEQ ID NO: 45559 - DNA, 1138 bp, Homo sapiens
  misc_feature (5)..(6): n is a, c, g, or t
  misc_feature (8)..(8): n is a, c, g, or t
  misc_feature (1093)..(1095): n is a, c, g, or t
  misc_feature (1114)..(1114): n is a, c, g, or t
taagnntnggtatcagtccggacggaagcaggaagcgggagcgtagggccacgcctgcggcgctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatgggtaaattaaaagttttacaacattctacctaatatttttcttttaacatactctttctgttctattgtattatggtgtccgaaagctaaataacgactaggaaaaatttttttaaaaaaagaaaaatcagtttaatgtgggaagtacttaagtggtattatattttacattttcaagtatagtgcataaagaatgttttaaatgtaactgttttcatggatttcaattagacatgcctataataaaacacgcaggcgggccgaagannncgaattaaatttaaaacanaagctaaccacacctactcaccac

SEQ ID NO: 45560 - DNA, 905 bp, Homo sapiens
  misc_feature (5)..(6): n is a, c, g, or t
  misc_feature (8)..(8): n is a, c, g, or t
taagnntnggtatcagtccggacggaagcaggaagcgggagcgtagggccacgcctgcggcgctgctggttgaggctgtgtgggtgggggacgggccgaggcgatggcggagaagtttgaccacctagaggagcacctggagaagttcgtggagaacattcggcagctcggcatcatcgtcagtgacttccagcccagcagccaggccgggctcaaccaaaagctgaattttattgttactggcttacaggatattgacaagtgcagacagcagcttcatgatattactgtaccgttagaagtttttgaatatatagatcaaggtcgaaatccccagctctacaccaaagagtgcctggagagggctctagctaaaaatgagcaagttaaaggcaagatcgacaccatgaagaaatttaaaagcctgttgattcaagaactttctaaagtatttccggaagacatggctaagtatcgaagcatccggggggaggatcacccgccttcttaaccagctcaccctccctgtgtgaagatcccctgggactgcgatgcggcgtgaggctgggactgcgagtgctgacgccaccttcctgctgaggtgggactgggccctggacacacccctcagcccctctgtcctcattgtttggcctcatgggaccgaggggctggaggagaggcggagctgtgccccagctgttccagcagcttgtctggcgtcaactggctttcagagtgctgacccctcatcactgtggggatcattctctctgagggcagatgaggcgcaggaaaatagtcttggaaatgttaaatatgatggtcacaataggagttattgggcattgggccccccctctatgttgacggaatctataagttctataaggccataaaggcgc

SEQ ID NO: 45561 - DNA, 508 bp, Homo sapiens
cagcacttttctctcctgctgccccatgtgtttgcttccccttctgccatgattgtaagtttctctaggcctccctagccctgtggaactgtgaatcaattaaacctctttcctttataaattacccagtcttgggtattttttaatagcagcgtgagaaggactaatacacacactatcccaaggttttagctggatcgctttcctggtgacaggacatctaagagagctcctgagatttaccatagatacacatttacctaggaattgggaagattaaggttatggggaagatgaagtcttttctctttttcctgcctccagaccctcatagttgggaagattcagaacactcaaactcattttatttgggctttcaaggtctctgagaaaggaaatatttccactgtagactttaaaaatggtctatggcttttctaaaaaaaatgagaaaagataagtttatagaaggcactggacattgtgaaaaagtagaagtctatgttat

SEQ ID NO: 45562 - DNA, 405 bp, Homo sapiens
tcttatgcctaactgagaagagccactgcaagttgcagttaggtacccatgtgcagcagaggccagctgaatcccagagcttcccaaagtggacaccagcggggactattcctgatgtcccacccaagagaggaagatgagctgaggcgctgttgtctgcccaaatgcatcccatgtgcattcacgtgtcacccattcaaaataacatggcattcttggaaccttgtatctgacatgtaagaccagcctacacattggggtgggtgcaggggctcacacttgtaatcctagcactttggaaggctgaggtgggcagattgcttgagcacaggagttccagaccagcctgagcaacatggcgaaatcctgtctcttcaagaaataaaataataataataataggct

SEQ ID NO: 45563 - DNA, 390 bp, Homo sapiens
tcttatgcctaactgagaagagccactgcaagttgcagttaggtacccatgtgcagcagaggccagctgaatcccagagcttcccaaagtggacaccagcggggactattcctgatgtcccacccaagagaggaagatgagctgaggcgctgttgtctgcccaaatgcatcccatgtccattcaaaataacatggcattcttggaaccttgtatctgacatgtaagaccagcctacacattggggtgggtgcaggggctcacacttgtaatcctagcactttggaaggctgaggtgggcagattgcttgagcacaggagttccagaccagcctgagcaacatggcgaaatcctgtctcttcaagaaataaaataataataataataggct

SEQ ID NO: 45564 - DNA, 390 bp, Homo sapiens
tttagtaagagtaattctaacaggagtgagttgataatctcctggtttttctttttgctttcctgattatagttgatattgagcattttttatatatcttgaccatttgtcttttcttgaaaaatatttaagccttttgctcatttttaatagttatttgtcttctgttgtatagtcatttaagttgtttatatgtttctgttattaaccctttgtcccacgtatgatttgcaaatattttctcccatttttttcagttgtctcattttgttgattgtatcagattccatgaagcagctttttaatttcaagtaatgtaacgtatctatttttcttttgatttccttggattttgaggttaaataataaaagtcacagcctagatcaatg

SEQ ID NO: 45565 - DNA, 483 bp, Homo sapiens
atatttccatccagttaaaaagcaggggaagggatgtggacgagagtgtttcgtgtgtgttgccttcctccacacccttcccccaggacgtccgcacacagtccacccccagccagtgtgctgccagacaggtggtctaaattcctcccagactgtgagattcagttcgtttatgctccaagatgaaaatatgccccttaatgattctgggaaagaaacaacctgaaccctccaccttacagatcctgtgattgcttttatttatcatcgtcgttgtctgctgaaagtgaatgggccgtgcacactggaggaaagtgccttgaagagaatattttttgaaagggaattatttgaacacgggaaagtgaaactaggtctgcatgaagtataggaaatttaagtatttaagtaacaaagatgttagcagggagaatttgcttaataaaatgagtcattaaagggtgttttttttaaagttctttg

SEQ ID NO: 45566 - DNA, 433 bp, Homo sapiens
tttttttttcctttgggggggagtcttgctctgtcgccagggctggaatgcactggcacaatctcagctcactgcaaccactgccttcctggttcaagcgatccttccacctcagcctccccagtagctgggactacaggcgcccgcaccacgcccagctaatttttgtatttttagtagagatggggtttcaccatgttggccaggctggtcttgaactcctgacctcaggtgattcacctgcctcagcctcccaaagtgctgggattacaggcgtgaccacccatgcctggcccttttaccttgtattcttgctagctggattcctatagcttctgttggtttttcctctggatctctcttcgagcacagcagaacaccattaagattataaaaaaacagcttctgccatggtagtgtggaactaccttcc

SEQ ID NO: 45567 - DNA, 407 bp, Homo sapiens
ccctgaaagtttatgacgtatcaaatatttctaattaaaatagaaaattaatcttcatgatgaaagaatcctaacagcgctttttatatgaatacaaatatttagttgggatataggttatagaatgtctttaaggccctgaagtcctttggatttactgtttttcattctagttcttcctttaatagctcggagcaaataaaagtgatttcctttagaatgtgcacatgctcctaaggatatctgaataaaagatacgtatctgataatttgccatctcagcatcatcccttgggcagcaggttggaaggcaatagtttaatctgaatgtgaactaatgcttatgcgcaaagacatgtatgtctcttcctggatttgaaggaactgagagtagagcagtttaacca

SEQ ID NO: 45568 - DNA, 328 bp, Homo sapiens
gccaggctggtctcaaactcctggcctcaagtgatccgcccacctcagcctcccaaagtgctgggattacaggcatgagccaacgcgctcagccatgttaggctttatggggcataccaatgtggtcggtaaggtctacctcctggctcctgggagtttctgttaatctccaagggtatgcctggcacccaagcgaggcctttatgtataggacatctataccctttgactcagcagaaccactcatggctattaaggacagatgcctccagaatatgagtacaaggatatgaatacagcactgtttataacagagaaaatatagaaa

SEQ ID NO: 45569 - DNA, 425 bp, Homo sapiens
ttagtagagatggggttccaccatattggccaggctggtcttgaactcctgacctcaggcgatccacccatcttggcctcccaaagtgctaggattacaggtgggagccactgcatctggctaatttttatcataactttatattctgctgcaagctgcttttaattattcaagttaagaggaaggtaaaaaaaataatttccagttcttacctgagctgaaaaaaatgaaaaagaatataagctgatctactcagtgcacaaaggggtgaaaattaaacatatcccaaattccaagactacattgtccaagtgataggagggagtgagagagaattgagaaaagatcagtaaaatatgaaatgaaaattattatcagaatatcctgggaactcaaatactgggaaagagttcatgggtccattc

SEQ ID NO: 45570 - DNA, 193 bp, Homo sapiens
ggcagatgacattgtgcatgtctataatccttttgcattatcataaggcttttcattctttcctgtcaactggtatcctctaagctactactcagtcatgtgtgacagatgttcctttggtagagttctttgcctaccagagttctcctcttaaggtggaggtaattggaaatgggggatgggaggacatcaa

SEQ ID NO: 45571 - DNA, 708 bp, Homo sapiens
cgtttcctttctcttcggaaatggcagttttgttgtcctggatgaaggcgagcgccgctgcctccctgaatgctgagcacgctggcttcgcggtgcccggaaggaagcctttgaagaccctgactccagtgtctccagctgagaggctgagcttgccagctccatttctgactgctcatggagcagaatcagtgaccaaggagaaaagggctgagtgaagaaacaagtgtgagtgccaagatgatgccaagggctgtgatttcctggtgggaagaaagaaggaatagaagccaaaggaagggggatgaaaagcaaaaccaagaatcacaaggaatcaagttcggagagaattttggcagagattttgagaggggggctttaagtcagccatggacatactgaagcaagaggaatgaagggaaaaaagaaaaggggggaaaaaagaagaagaatggggccaaggaggatttaagactaccattataggttacaagttgaattctttttaatattcttcaagcaatgacagtaaagattcaaataacttttaaattacctttgatttctaaaccaagtttcttggaatgtgaaagtcgccaagactgggccctgcagggcctgggttgggctactactgcctatggagattctgagggtattaaccttaataatggcatgaaatcaataaaaatcatccaaaagcttttt

SEQ ID NO: 45572 - DNA, 439 bp, Homo sapiens
atggagctagggtgcgggccgaggctcctgatggatccctggagaacatggggcagcagatggtatgtcttgacggttcttcaccaaccatccatcccctgctcatgcgtgtgcgctctctcgcgtgctcgctctctctctctctcatatatgtatatgtatatatgtgtatatatatatatagccattatatatatagccattatatatatatatttttttttttttcttcttttttaagggagtgacttgctctgtcacccaggttggagtgcagtggtgcgatttcagctcactgcagcctttgcctcccgggttcaagacattctcctgcctcagccgcctgagtagctgggattacaggcgcccgccaccacacccagctaattttttgtatttttattagagacggggtttctccacattggccagggtggtc

SEQ ID NO: 45573 - DNA, 426 bp, Homo sapiens
attggatgaataatgtacaaatattttcccccattctacaggttgtgtcttcactctgttggctgtttcgtttgctgtgcagaagccttttagtttgacatagtccctttgtctatgttttttttgtttaaatttgagacagagtctttctctgtcacccaggctggagtgcagtggtgtgatcacagcttactcagcttcaacctcccggcctcaagcaatttccccacctcagcctctcaagtagctgggaccacaggcgtgagccaccatggttggctgatttttccaattttttgtagagatgaagtctccttctgttgcctaggcttgttctcaaactcctagctcaagcgatcctcctgcctcagccttccaaagtgccataattacattcatgagccaccaagcctggcctcaagagtt

SEQ ID NO: 45574 - DNA, 761 bp, Homo sapiens
ctgcattatttttagactgttttacccaattaattttattatcagttaattatgtattaccaccttaagaaaatgaatatttgcccagttgcttaagctaaatcattaaatatgtatgaattcctttctttaaatgtacacctgttatcttttacagatgcagaagacgtgtttggagccatctgtgcctctgaaacagacccccatacaaaagtgctgtcttggccctacgagacagctcatgtggggctgggaggcacctgggaagtgaggcccacaaacatgtcagagatctcggcctcagcgtaagtgggagggccactgtcctaagcaccagcttggcagaatctggggtgaggggaggtgggtagagcccagagccaaatgcatgaaggtgcatgaatacagagcagcccctggagggtgatagtttaagaaacaaacctcgaggctgggtgcagtggctcacatctgtagcccacagatttgggggccaaggtgggaggatcatttgaggccagaagtttgagaccaagctgggcaacatagtgagaccctgtctctgcaaaacaaaacaaaagaaacaaaatttagcgaggcctgatggtgcacacctgtagtccaaattactcaggaggctgaggtaggaggatcccttgagcccaggaggtagagcctgcagtgagccaagatcatgccactgtacactgcactccagcttgggcaacagagtgagatcctatctcaataaaaaaagaaaa

SEQ ID NO: 45575 - DNA, 463 bp, Homo sapiens
agtttttaaagacactgtgaatcaatgcccatattacgcttttggaaattctcaagtttcttgtcaaataaaattggctaaaagcaagtctttattatctgactgtgctgggcctaaaaccatgccaatttaagaaagagaaaaatatcctatttgccatctgaaaactgatcacaaaggcactgagtgtttcccgcagaatagaaatgcaatgttgggaaatctcagttacactcctagtgagtatgaggttgtgagtcttgcctgggaaacgggaaggttgttgcctttctcaaagggaagggatggattatcccagccgtgggcaccccatagtacattgcctgagaggcatcaggctggtgtggaattgcaggcacacaaccccccttgcctgaacataatgtgtctttccttcattcagctttttagactcaggatggcaaaactcccgtccggccct

SEQ ID NO: 45576 - DNA, 735 bp, Homo sapiens
agtttaaaaagtaattctcctacacacctatctcaaactttgctatagtgcggtcagtggtggtcagcagaccactggtctgggggtgttgaagttaggccttcttatacttgctcttatgcagagttcatgtatttggcagaccttcagtggtggacatctctaccctcaatacaatttctggtgactaaggaggggaagttgtttgagctgactgatgttttggggtctaaaattacatagggctaaaggaataacgtttcttacgtggtttttaaaataatagtgcttctggaagtggaatttcaaaattattttaagcaatggaaataagggagcatgcatcacttagctaagttgattactttaataaacaatactcatttgagtgtacatatgacttactgtcataccttatttatatctgtttgttgtaacatttattcacatagtattcattcatattactgagtgcctaccttgtgccaggcactgctctaggtgccgagatagagctgtgaacaaaacagacaaaatagacaaaatctttcctcataaattttacattctaatgtgagagaagcagtctgacaattctaagtacctaacttataaaaataaatggcgattcatttcttggctgctcaaaattgaacattatcttgtctattacaaaatatataggttcattgatgttcaattctttagactgtagatagcttgtgacaaaaaaat

SEQ ID NO: 45577 - DNA, 616 bp, Homo sapiens
tggaaacaccagcttcatttttccttctggaatgatacctcttctcacactcaaactaagtggttttggtatagctgatttcatcccccacactgagttgacatatgacccaggtagggttaccagataaaacacaggatgcatacttgggaatactaatccaaaaaaatttattcattgtgtatctgaaattcaaatgtcctgtatttttatgtgctaaatctggcaactccacatccaggcctattaataggacactagattgatttggaaaaggccatgagtcctaaggtaggctgaggagagtcatcctttggacatctgctggagctctctgggaaagagcctgtctcattctactggggttgcaaagctagcagaacatatgatcagctgcagatatgtgcccatgacccaaatctggtccatcagaatactattttccccaattacaatgtttgactgatagctgggcatataacccaacccaagccaagtcagcaagacttgaccatggagctgatgacggaattaatgggcaggagaaatctctgtccacgggagttgctgagcttgaggaatgtaagcctgaagctgctggcagatatctcacccc

SEQ ID NO: 45578 - DNA, 677 bp, Homo sapiens
tagtatagacggggtttcaccatgttagccaggatggtcttgatctcctgacctcatgatctgcccgcctcagcctcccaaagtgctaggattacaagcatgagccaccatgccgggctgaaaaattttctaagtaatgtctaattccactttcctagtagttacagttcagtgagtgtaattaccgtctgagggttgaaaactggtggcccatgggctttatctatcagcaaagatactttgtttgactcacaatattaaaagcagttcattgattagtgttattagggcactgcctctccagttgatgtcagtccctatcatgcctagtatcttacacctggcctgcttcattctcttgtattaatattacttgcctggcaataggtaataatcctattacatgtcttgcaaaatgtaatcatcagtttacatgttcacgtgagtgagatttcaacccctgaatgaaactgttctttaatgatttagcttctttgggtgtgtcaggatcatctttgtgagcatttttctctgtgcagtgctatagaggtaaagatatacatcaggaatgtattcttgccattcagagattcataaaattttaatagaagataatttagagattgagtgcagaagctgagaccaagattgggtaaataactgaccaaaggtcacaa

SEQ ID NO: 45579 - DNA, 433 bp, Homo sapiens
gagtttaagtaatttccccaaagtcacacagccagttaaggggcagagccaggatccctaggccttctggtacaataaatattatttgtattatgactgtgcccaccgaggcactgttaaggccttgacatccatgatcacatttagctttgcagatgagaagctgggacttggagaggaagaggaagacattgcagctgacccgggtccccctgtgcctctgctcaccaagtctgcccagtgggcctcctgcatcagacacatctgtatgccataaaaatgcttattcctcgttgagtcttagccagtgagcttggggatggattgtgagaatctgcattttaataagcagccccagttgatcctgattcacacagaaatttgagaaaccttaccaccctgcccatcctcatccattagagcacattctacc

SEQ ID NO: 45580 - DNA, 420 bp, Homo sapiens
aaaaaattaatatactgaaatgttcaacatgcatcatttgtttataggtttttctacacaaggatttttcttgaggctgtgctgcatggttttactagcactgcaaatcagagcagaaaagttcctataatcttaactattagcaagtagtgtgtgcttcttttgacttaccaggaaagtacaagagctttctgtttagaccattgtctatgagataacttcccggctgtcagctaagtcatattaaacccactaaggcagagactctttggctctgctgggtggaacattgttgttatggactgaatgtttgcatacccccaaattcatatactgaaagctcaactctcaatatgactgtatttgaagacaattatgaaggtaattaatgttaaatgagttcataagggtgggccctga

SEQ ID NO: 45581 - DNA, 401 bp, Homo sapiens
tttttggtgacaaagtatatgaaagcattcatgaaatgctaataaaataataactgaaaaagaattatttattgaatttttaaagatttaacttacttttagctaatgcaagcctaattgctaaaacactgaaacttagaacattaatctgatgttataaaatactggtctggtttccgcaaaggcttggaaggcacacaggacttctaagtagaacagcatgagtaaacacacttgcctttttcaacctctcagaatggccctgagtatttctgatttaattttgatttttaaaaagactttgtgttttgaatttgaatacattttctcaggttgtacccagtttaaacagacaatatcagaaaatgtactatcttgaataccaaactcttacaaattgg

SEQ ID NO: 45582 - DNA, 80 bp, Homo sapiens
gaactcattaccggaagcgtgctactgttatttgggtaatttaggaacctgcatcttaatctggagaacaagtaacatag

SEQ ID NO: 45583 - DNA, 432 bp, Homo sapiens
atggaatcatcatcaaatgaaatcaaacggaatcatcaaatggaatcgaatggaatcatcattgaatggattcgaatagaatctttgaatgaaattgaatggaagcagcatgaaatggaatctaaaggaatcatagaatggtatcgaatggaatcatcgtggaatggaatggaatggaatggaatggaatggaatcagcatcgaatggaatcaaaagcaatcattcaatggactctaatagaatcatcgaatagacttgaatgtaatcatcatcgaatggaatagaatggaatcatcgagtggacacgaatggcatcatcattgaatggaatcgaatagaatcatcaaatggacttgaatggaaacaacatcgaatggaatcgaatttagtcattgaatggcattgagtggaatcataattgaatggaatct

SEQ ID NO: 45584 - DNA, 411 bp, Homo sapiens
gttattgcaacccaggatttttcagccccagttataaaactctgccctgtgtttcagaccactggtcaaactacgtgacccaatttctgctgtcctcaccctggcttagttaattggaacattgtgctaagtaccaaggtcagagatgagtctctgtggatgctgtaaagccattcgattttacagtcttgcttaaaccatagcttctactttactttttttttcttttcgtcagcaatcactggggaagggaaaccaacacggatgcctcagtcaaggaagaaaagctgccacatcatttcagtactaatatcggctaagcttaatagagcatttttataaattaaggaacttaaaacggtattatttttaaaaggactaaaaataaatacagacatagtttctaaaaag

SEQ ID NO: 45585 - DNA, 392 bp, Homo sapiens
gttccatagaagatccaaaaaaccagacttttagagtataagcagtcaaacttaagaaaatattatatttacttatgaatagatgctaagtcaaaagtaagtccctaataaattttaatgtactgttgttcactaaatgttcctagtcatttgggctcagtagttcagtcatttatcataatgtgtatcaagatagttactggatattgaggtattgtttataacattacaaatagaaaaatcctagtgtttgggataggaaattaatcatatcttgtcgatccaaacagtggagtgcttttctggacattatagatgataatgtaggtatttgttgatatacagagataccagaaaaaagcccatatttacgatccaatgcctattttgta

SEQ ID NO: 45586 - DNA, 524 bp, Homo sapiens
cctaccgcttcccagatctgtcctggggtcaggaaaaggccgcagaatcataaagaaatgaagctgatttcacttcctggatcaccagttttgttccctcagcacgactccctgagagtcttctctccagcctaaccatgcacttttccaagcgtcgagatgcttagaaacttccaaaaatacttgaccacagtgccagaaagacatttctaataaaacttgccagcaaagggctgggaagaccccaagtgtctcttgtcagggaagctttatagacttagctcctgggagccagctgggccctggcttgctagaccaccctgcaagggcttggcctctctccccagcccctgccaggcctgctggaagtagtggctggaaagaaatgggggctttggggtcagggagcctgtgttccaactccggctccccttgcactggctgtgtggctttaggcatgtgactgaaccccaagagccacagttcattcagcaataaaatgagagcttctgtcaaaaaaaaaa

SEQ ID NO: 45587 - DNA, 843 bp, Homo sapiens
ttcttttatagcaaaaattggcttggaaagaaatcatggttaacttcttattctgtagactgttaaaagacttgaggcccagagaggtgaaatatcctgcctaacatttcccagtgagttagtggcagagctgggactagaaaccagatcttttgaggaattccacacacaaggaaattacttggctgggtcaaagtcacaccctgagtaaagtgggaactgacaggatttcagccaagatctgtctgtctccaaagtctacgctttctaggactctatacactgctgttttaaaattaattaggcattctaattacaaacttacctcaggctaagttatgacagtagagaaagacattagatgaaagctgagtccctctgcctctcaacaatcttactccgtcccacctgctcaaaaaccctctatccccattccctagaggtaaatactgtgaattgtttttggtatacacttcctgaaattgcatgtatatctttaaaaaagattttatttggaaaaacattgaaacttacaaaaaagttgtaagaaccgtaaaaggaactttttacctggattcactgctgttgacattttgccccatttgctttatcatttcttctctatagctacctatctatatatccatccatctattgattgattattattttttttttttgagatgaatttcagtcttgttgcccaggctgcagtgagctgagatagcaccactgcgctccagcctgggcaacagagtaagaccttgtttcagaaaaacaaaaaaactaaataaaagttagaataaaaaaagcactttcgtaagaaccaaaaacaaacaaaaa

SEQ ID NO: 45588 - DNA, 344 bp, Homo sapiens
tttgaaagaaatacacataaagcatatccctctcttaattctttgaaataatttccaaaaattataattatttttaaataagttaaaagtaaatttaagggaactgaaaattattaaggttcttgattcttgatgcttattggcatgttaccttcggaaagttggtgcatttgccattctacctgacgttctacctgacatgtttaagggtcatagttctctttatccttgtcaacatgctgaatgttatcatttaaaaaataaataaaactgtgtgtgtgtgtgtgtgtgtgtgtgtgtgtgtgtgtgtgtgtgtgtatagtcatctgcaagttgaatgtgtt

SEQ ID NO: 45589 - DNA, 459 bp, Homo sapiens
acctcagcctcttggatagctgggactacagatgtgcgctaccatgcccagctgatttttggaaattttagtggagacagggttttgccatgttgcccagactggtcttgatctcctgggctcaagcaatttgcccatctcagactcccagagtgctgggattacaggcgtgagccaccgtgcccagcctagaatttgtatatactcaaaatagtttacattttgcatttttctacatgaacatatgcatgtattgctgatctttccctactttttgcaaatatgatagatttcactatatacaaaacttaaaacattatacattaactcaaaagcattgtcaatttatattctgaaataatgcaaattttaatttttttaaaaacaaaacttctacaagattattatattattttaggagactaaaacataaaagcctgatacttaagtagtttgaat

SEQ ID NO: 45590 - DNA, 725 bp, Homo sapiens
agctgggattacaggcacgccccaccacgcttggctaatttttgtattttttggtagagacggaatttcaccatgttggccaggctggtctcaaactcctgacctcaagtgatctgcctgcatcagtctccaaaagtgctgagattacaggggtgagccactgtgcccggccaatttttaaatttttattttttgtcttaagatcttttttctctaacctgcttcagagaaagagaaatgaaggactaatacttcataatgaagcattatgaagacagtatgtgaaaggagccatcataaaagactacatattgtagagcagcggtccccaacctttttgataccagagactaattttatggaagacagtttttctgtggactggggggcatggttttggaataatttaagcacattacatttattgtgcactttatttctgttattcattataatatataatgaaataattgtgcaatttatcataatgtagaatcagcaggagccctaagcttgtttttctgcaactagatggtcccatctgggggtgatgggagacaatgacagatcatcaagcattagattctcatgaggatcatgcaacctagattcctcgcatttgcagttcacaatagggttcatgctcctatgagaatctaatgctgccactgatctggcagacggtggagctcaggcagtaatgagagcgatagggagcagctgta

SEQ ID NO: 45591 - DNA, 516 bp, Homo sapiens
aattccatcacctaaaacatcggcgacatctatttagaggtgttgaaagaattagaatccatgagtgaaaagtgcctcatacatggtggattctcaagtgttcatgaaactggtctgtggtgaaatcagaggatgttcacgttctcgtggcacgtgagctttatgtggtagtttgcctctgttagaattctccgggttagatgcagtgggccggagcttgaaggcaaaaggagagtcacatttgtatctttaaagttacagttactcagttgccctctgattattgttgttgttgttagtttgagaaggagtctcgctttgtccttcaggctggagtgcagtggcacggtctcagctcactgcaatctccacatcctgggttcaggtgattctcctgcctcggcctcccagctactcgggaggctgaggtgggaggatctcttgaggctgggaaacagaggttgcagtgagccgagatcacgccactgtgctgcagcctgggtgacaaagtgagat

SEQ ID NO: 45592 - DNA, 329 bp, Homo sapiens
caaaattaacagatagagagatagatactagatacatagatagataaaaattagacaggcacggtgggacctatgtttagtcccatctactcaggaggctgaggcaggaggatccattgagcccaggagttggagcctgcagtcagctatgatggtgccactgcactccagtctgggagccacagcaagacaccatctcaaaaaaacaaaaataggctgggcatgaagactgaagactgcgtaatcccagcactttgggaggccgaagcgggcagatcacctgagtccaggagttcaagatcagcctggccaacctattgaaaccccat

SEQ ID NO: 45593 - DNA, 476 bp, Homo sapiens
tgaacagggcaggacagcgccacaaagactgtgagggctggtgacagggaagggaaaatctaacaggagacatcttgagctcatgggcaacaacttcccaataagaatttaagatggcagagtttggccttcctctgggggcatgaccagacatgcgcagtaaggggcaaaatgacagagtttgacaaatatatgaccttcccatggggcttggccgggagtgctagcccagtaagggaaaattgccctaagagagcatgtgcataacttcaatcaccaaaaggcccttccagatactggcaaaccactgcacatacagggagggaagagatggggaaaaaaataggaaataataaatctctaagagccctaagacaaaggtcaagctgggtactcaatcttttgacgtcccccttcgttccatccaagtgtacttttttttgcttcaataaactcttgtttctgccttaaatata

SEQ ID NO: 45594 - DNA, 521 bp, Homo sapiens
cttttggggtctttgctcttttggggtctttgctcttttggggtctttgctcttttggggtctttgctcctgctactacctctgcttgaacagctcctcaccttccttcctccaaccctacccttgtataggtgacttttgttcatccttcagaattcaactcacatgtctcttgcatggagaaccctcacctactgtgttgagaccctgtccagcccccaggtgggatcctctctcgacttcccatacatttctttcacagcatttacatagtccatgatagtttacttgtgggattatttggttaatctttgcctttaacaccagggttccttgggtgaaggagcttctttatcttggtaacagcattatttcaagcataacttgtaatatagttatattacatatataacatatatatatataacataacatatataacatatataacaagcataacttgttatatagtcttgtatatagcaaagaccccaataaatatttggagaacaaaaaaaaat

SEQ ID NO: 45595 - DNA, 455 bp, Homo sapiens
cggctttggtgcttgctggagcccaggccttcaggttgcagatggttctagagcattgcctttgcaataaacagtgtttttgattcttgactgtttttactcacatcattcccttttctgagttgcattatccccacctggcaggtgaactaacgggctcaagaggagtggattctggtggcctcagtcccctgtagggcctacaggcttgatctggagccttttggggacaagaacctaatgtttgtttcctgcagtgctgagaggggtttggggtagcctgggatttcatatccttggagtcagataccttctcactggataaccttcggctaaccacttagctgccttgagtcttctaaaactgggataatagtccctccattgtgaggactaaaaaacttaaatgcacaaaaggggcacggcaggaggcctggcttcctgaggtaaatgcc

SEQ ID NO: 45596 - DNA, 427 bp, Homo sapiens
acagctcgaagtagatggtgctggaggagtgtttggagattgatcagaatctgaatatgttctgtggataaaacgaataaaatttaacagattcagggctaggggtgttgtgtgagagaaagagaagggtcagagacaagtccatgctttttagcccaagcacggactccctgccttaatctaaacatggtgttctcctcatgcaggtgtctatgttccaatttcccctgtatataataacatcagtcctattagattggggtccaccctattccagtatgacctcatcttaactaattacatctgcacaaccctaatcccaaataatgtcacattacaaggtactaagggctaggacttcagcatatgaatttttgggggacacagttccatccatagtagttgccgttaactgagaagaggatat

SEQ ID NO: 45597 - DNA, 401 bp, Homo sapiens
agataagaaaggctatttgaggtccataagcaccctcatctcagagaatttggattctataaaccatgactgtctcagcatccctccgctggtttcatataatacagcctattctcacctataaacaaggttctacatacttcttagagtcaaatgtgctttatttctcaatgattcaagtcccaagcttactcccaaacccagcaaccttaggaaaatactgtgcgttattcaataaaaaaggatagtagagacattaaaaattttagcttgcattaccaatcattaaggatttgttggctgcctactgcatgcaaggcactgtgctacaccaattatattatttattccttaaaacttcacagccttaaacaagattccatctgtgaagttgtacagag

SEQ ID NO: 45598 - DNA, 264 bp, Homo sapiens
gtgggaactaacagcaagaactcactcattactctgaggaggcaccaagccattcatgagggatccacccccattatccatacacctcccattaggcctcacttccaacactgcggatcaaatttgaacatgagatttgagaggacaaatcccctcaaaccatagcagggtataactcaagaattgatttgtgcctctttaacatggttggaaagatggctcctttcttttattgtgggtttttcttgccactcctttaaacaa

SEQ ID NO: 45599 - DNA, 302 bp, Homo sapiens
tgcgggctattgagaaattcagtcgatatagtgaactgaataaatagacggtggctgaccccgggtgggaagcaaggtgtgccgtgagacggggttgaagggaggagggtggtcagaggtgcaccgaagagaacttagactctacagatgagcagagtgcatgatttccaatctaaaattcatgttcaatttagaaaatttgagatgtaaaaaacacttttacaaaggagaagttactcctttgtagtcgctgtttttgttttgttttttttttgagacagagttttcgctcttgtcaccca

SEQ ID NO: 45600 - DNA, 2192 bp, Homo sapiens
aatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcggtggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcaccc

SEQ ID NO: 45601 - DNA, 831 bp, Homo sapiens
gaaaaagagtcccagctggccaccttctcatgtctacacctttcttcaattaatggttataataaactgtttaacctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcaccc

SEQ ID NO: 45602 - DNA, 2174 bp, Homo sapiens
gaacccacactccgcatctgccactcctagagccgggactagctcccgatcctagcagttgctctcgagatcatcccgggagttattggcgagttctgggcctctggaggtttccctgtcagcctccccggccgccgagggggcgcgcgcccaacaagggggtctctagcggccacctggggacagaaacagtgaccctgggcgcgcactttgcctccccgttagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcaccc

SEQ ID NO: 45603 - DNA, 2120 bp, Homo sapiens
gaacccacactccgcatctgccactcctagagccgggactagctcccgatcctagcagttgctctcgagatcatcccgggagttattggcgagttctgggcctctggaggtttccctgtcagcctccccggccgccgagggggcgcgcgcccaacaagggggtctctagcggccacctggggacagaaacagtgaccctgggcgcgcactttgcctccccgttagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacaggaatctaatatccccaaattagggcaattggaacaaagtgaaggacatagaggtatattggaagaggcagagcctgaggtggtaggaggaggaccctggaaatggactggtttgagattgccccaggtctgggaagctgagggcaaatccagtcccaatggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcactttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaaccaacctttgtcatattagaatgtgtagtgttcacatgttgctcagttttgctaactgataaatcatttaatcctcttcttcatatgtatgagtactatcttatatctgtggtcaagagtgaggtaagcaagctccaacagaccctgagaacctacgcttgtatcctttctttggctaaagaaagcatgtctgtttcctgtcaattctttgaacatacagagtaatctttataaacaaaagaaccttcaccc

SEQ ID NO: 45604 - DNA, 353 bp, Homo sapiens
ggcacacacacacacagtgcacatatgtgtgcacactttcacaattgccttctgactatcaatctttggatctaaatggtgaataattcaggtgttgcaggctgttgctactcactgcttatacagaatttcagttccagtgattatccctagaatcctctgagaggagcttatgaaactcctcgcccctttccacctctcaggaattctccatggtagctctcctgggcactactcctgcgccatggggaatagttatgctctccaggtacagtttcctcttgctcagttgcaaactggattccttgaaatggcaaagcttctttatgttttattctgaagggaagataata

SEQ ID NO: 45605 - DNA, 2122 bp, Homo sapiens
tgaagttaatgagacaggcctcttacttccttgcaaaatatgctgtaggctttccagaatcccgtgtgctcttgcaagtctcatctactccttacaaatctgaatttgataggtttctgccatgcatgagaagctggtgcctatattcagtttttattgcccatatgccttattgtaggtacttgtattgagggaaaaaccttatatgtccaggtaggctacagagtcaaagaggcttgtccaaagtgttatttgtagtaggtgagtgacactgcatctgcgtgtttttcttttttattggcctttggtagtcagacttttatgatttgttgaattataaaatacatgtaaactgtaaacctgctttactcagtttgtttgacttcatttgcacttgctcataatgattgagtttggcccccacgtccaaaagacttgagttcaaattgtggttctgtcacattctctcaaccactgtatcaattaggactggaattggttggaatatagtggctttgacagtttcattttttgctcaggcaagtaagtccagaagtcattagggccccaagaagcttctgcccactatatgtagactttaagcttatggtccaaaattagtgccagagctcctgccatcacttctgcattccagatagctggatggtgaaagggcagaagaagagtgtgcttccctcctggaagacttgtaagacttactaattatatctcatttactagaatttgatcatgctgccattcctagctgcaagaaactgaggaatatagttttttaactaagaaacagacttgtctgcaactgcactcagccattcttcacatactgatttctctctgggtctacttctcctggggttattagcagggttgttattctcctctgctttgtgtagcttttcttttttgtatagtttcttgttattcatactagtagctttgtaaatttagattgctgtgattcttcatggttatgaagttatttaatagctttgctttttgtattccctcagttttattttgcactatgaactgcttcatcttttcagtatttttcaactcaaatttgggagaaaaagaatatgattaggttagcctggcccttcctgctaggccacaccatggttgttggtcagctactaaggctaaactgcctgctagttcaatcagctgtggcatcttgcttgtgggcctttgcatctaaaagggtggggaggcaaaacagactctatgatgtgaccatgctaagtccctgacaaatggaaattcctttggcagggagttagagataagtcttaaaatgaggatgttttgtatattcatatgaatgcattttaattagtatgtagattgtcagttaatagttatcaataattgatatcggactgagaagcaattatttgcaaagactaggaaggtgtctagggcatgcattagcagccctcagatgcttgcgcattatgggatgtttcttgctttcacttttatctggaatgccgttttcttctgtgctcctttgaacttggatacctctcaatcttttgagactcaaaattcaggagatgcttccaagtctttcctgacatgcctataagaatgactttgatgcctctactctgtttccctaaagcccattgtgcatacccctgattgtgctgaacacatttacattgcacttgtctggcacaggtatgtttaattaccgctttctcctgaactggaagatcactgatgctagggtttggtcttctttatgtttctatacttaacacttacctagaagtgcttgccacattaaggatgctctgggccaggtacagtggctcattcctgcaatcccagcactttggcaggccgaggtgggaggatcactggagcccaggagtttgagaccaacctggccaacatagtgagaactcatctctacaaaaaaataaacaaaattagctgggtatggtggcgtgcgcctgtagtcctagctatttgggaggctgaggtgggaggattgcttgaggcaatcctggacaggaggtccaggcagcagtgagccaagactgcgccactgcactccaacctgagtgacacagtaagaccctgtctcatt

SEQ ID NO: 45606 - DNA, 485 bp, Homo sapiens
atttacttttgatttagctattgctcaccacagaagaaagttagcagtttattagatgaataagagcatgaggatagatcccaagagaaccaattactgacaccgtggaaatctgccctgtggagatgagctattgtgaggcacagccaccagagcgtgttctggctcatgtgccatcttggtatagtcacccagacttgagcccagacgcacatgcacctaaaaatagatacaattatatgcgatgtgtgtgactcttgatgagcacatgaaaaatgttgcctctccacctcaagtacactgctcctttacctggaggtctgcctattcttgcctctccctgccttttctgattattcaaattcattggtcaagctacagtcaccgtgccctcttgttgagaactctatttcttctcccactggaagggagattctcttcctttgatctctcctggtgatatttttttctattgggagtgtttc

SEQ ID NO: 45607 - DNA, 308 bp, Homo sapiens
gatgtcaaggccgccttatacctagtattgatacaagtaggatttgcatctcattaacttgagattcttttgcagatatttctaatgggatttcagaaactcactattgattataaaaagttcagttatcttctagcaatttaacattgtttttaactaatattatagttgacatatattattcaaaaatagcgttttgccattgttgataggacataactactgcatgttaatttggagagctatttaaatattggaggagcaaacaactttataccaaaaatttggcaagttgaacaaattccttg

SEQ ID NO: 45608 - DNA, 409 bp, Homo sapiens
cacttcaagtcaggagttgagaccaacctggccaatatggtgaaacctcatctctactaaaatacaaaaaaaaaaattagccaggcatggtggcacgtgcctgtagtcccagctactcaggagactgaggcaggataatcgcttgaacccgggaagtggagtttgcagtgagctgagacttgagccactgcacttcaccctgggcatcacagcgagacaccatctcaaaaaaaaaaaaaaaaataggcttggtggcacacacctgtagttccagctacttggaggctgaagtgggaggactgcttgaggccagagggttgaggctgcaataagctgtgatcatgcactccagcctggacaacagtactggagtttaagatgggttttttaagaacccatcttaaaaaaa

SEQ ID NO: 45609 - DNA, 457 bp, Homo sapiens
gtactggctttcagctgggagctcagttgttggagggtagttctcttccacggagcttctcctcatggctggtgttggctcctcacagcatgctggtttcagggtcatcagaagtcttacaaggtggccgacttccctcaaggcacaaaagcagatggtgccaagccttcaaaatgtgtgatcactgacatcccagaatgtcacgttcaccacattgtatcgtaaccataataagttcattgcacaatgcacacagcaagtcaatacactgagacatgggttgcagtagagaaagaggtttaatcataaggtcaccacatgaggagttgggagtgaatctcaaattcatctcctcaaggaatttagggttaggatttttaagggttttggagtgggccgaagtgtggagattgttatttattgaagagtgccgggtgaagtcatgggacagggtaag

SEQ ID NO: 45610 - DNA, 558 bp, Homo sapiens
gttaaactaaagaaaccatatacaaatttcaagtcaggtgcttttactcattttataccttgattcttgaatggccagattttctgaaaatacccagttaatgattagattatgctacttcagtcaccacgtgtttgaaggctgatcacagaaaactagaagcaatgtaactagtttcaaaatataattaaatggaggaggaagtgtttggcttttttccctccagaccacaaattggtaggtaaagtaaaagttagatttgaaaattgggcctgggtgtggtggcttacacctctcagcacgttgggaggccaaggtgagtggatctgttgagtcccagagtttaagaccagcctgggcaacatggcaaaatgccatttttactaaaaatacaaaaatgtagctgaatgtggtggcgcatgcctgtagtcctagctacccaggaggctgaggtgggaggatcatctaagcccaggaagttgaggctgcagtgagccatgataatgccactgtatgccatcctgggcaatggaaatgagagacccccgtctcaaaaaa

SEQ ID NO: 45611 - DNA, 808 bp, Homo sapiens
cctcctcctaaacgacccatgtcaccaaagcagtccctttcgtctccacggtagctgtaggatcgtcttccttctcgtgtgggacaataacacacagaatcagcatatcatccctccctggctatgtcaagtagcaggcacgttcttggtgacggggagtctgtcgagatgttctcaaatgcagtgtgacgccccttcgagataaaagggactactcagccagtgtcaggcctgcagaggttgcttattggcagatgggacttgctgctgctgctcagcccctaaacaaggactgcagactcaatgcctacaggggccaggccaaggcagaagagggaagcaaggtggatatgaagcagtagggagtggtggggaccctggagccccgggaaatggcgggccttcaagggctgcacactcttggccccccaggaaacggcccatcagggctccctgagctgcccatgtcttcccgagtctgcagaggggtcagaaatcctggctgtttggagaaatctcccccctcccagcctgggagacagagcaagactccatctcaaaaaaaaaataaaaattaaaaaaaaagccctgaacctagaaacggacctacaaatgtcaatacttagtaatatttttaattattaagccaagatttccaaaaataagaaaagcataattgattatactggtttcttttttttttttttcatttggaacatataattgagaaagctttagtatcaagcatatgtaaagactcataaaataataaggaaaggcaaaaactgcctgatagaccaaaaaaaaa

SEQ ID NO: 45612 - DNA, 264 bp, Homo sapiens
tagatgtgtagaacaagtttaatgcctggagtatagtccaaagtttttgatgattctttgttatctttattatttttttacccaaattgaaacacagaatttaaacagaacaactcaagtatgtccttgtaatatttcctaggattttcttgcattttaaacagataaacatagcctacctgcaaatatgcaactgtatatgcactagtatctaaccacgtaaaaaaaaacaaaaggtggccaacatcaagaaaaccgtttgtg

SEQ ID NO: 45613 - DNA, 389 bp, Homo sapiens
  misc_feature (216)..(216): n is a, c, g, or t
  misc_feature (218)..(219): n is a, c, g, or t
  misc_feature (223)..(223): n is a, c, g, or t
  misc_feature (229)..(229): n is a, c, g, or t
  misc_feature (236)..(237): n is a, c, g, or t
  misc_feature (322)..(322): n is a, c, g, or t
  misc_feature (327)..(327): n is a, c, g, or t
  misc_feature (349)..(349): n is a, c, g, or t
  misc_feature (362)..(362): n is a, c, g, or t
  misc_feature (382)..(382): n is a, c, g, or t
cggtggcaggagaggttgtggtgctagtttctctaagccatccagtgccatcctcgtcgctgcagcaaacaccgctctcgccgccgccatgactgagcagatgacccttcgtggcaccctcaagggccacaacggctgggtaacccagatcgctactaccccgcagttcccggacatgatcctctccgcctctcgagataagaccatcatcatgtngnnaacngaccanggatgannaccaactatggaattccacagcgtgctcttgcgggggttcatttcccattttgtttaggtgatgttgggttattttccttcaggnggggncagtttttgcccttttcagggntctgggggggttngggaacccttgcggcttttnggggatt

SEQ ID NO: 45614 - DNA, 353 bp, Homo sapiens
ctctcctcattaccacttccccttttagagcctcagtttccttgtctcttgagcattaaggaagatggggggccaggcacagtggctcatgcctgtaatcctagcattttgggagtccaggatgggcggatcacttgagctcaggggttggagaccagcctgggaaacgtgatgaaaccccatctctaccaaaaatacaaaaattagcctggaggggtggcgggcacctgtaatcccagctactcgggaggctgaggcaggagaatcacttgaacccaggaggtagaggttgcagggagccgagattgcaccattgccctccaggctgggtgacagagtgagactccacttca

SEQ ID NO: 45615 - DNA, 226 bp, Homo sapiens
ctactattttgtgaaaacacaatccgatttacaatcaggactgcccttatctataaagctgctaatccctgagccttcaaggggaaatatacccaactgccagtctttgggtttacaacaagaatgaccctttgagaaccctttttctaaactggatttagaaaaaacattgatccatcaatcctttgtccctgaagtcaggaagtaatttgccagtaagagactg

SEQ ID NO: 45616 - DNA, 343 bp, Homo sapiens
tgagagctgagagtgaccattcccagggaaaagtaggggaatttggccctctacagcgaaggtcagagcagatgggttggggcttggttctggaggccagttgtttccccgagtgtgcctgacttctgcttctgagtagcgaggggacccgcagataaaatccagcaaagtgccttaggctggtcccttggcagggaaagggaactgagaaggagccagggagccagctggtggggtccacactgttccctggagagggcgtgggccccaggttcagtcctgcttctggcaccagatagcggtgagatctgagcaggaggctgtccctcttggagttacccat

SEQ ID NO: 45617 - DNA, 427 bp, Homo sapiens
tgatggccaggggtagatgggacccaggtgaccttcagtgccttgactccctgggtaactgcctgccccttcttcactccagacaggccctgcccagatcactggctcattctccctatgactgcagagttaagaacatctcgggtcttgagcagcagtgtggttaagtgatcacatgtttggatgcggaggattcatctgtagagtcagctccacttaaacatggagacaaaactgccatcatctgcttatgcctctgggtgtttgcctagaaactttgctttgaccagaatctggaagtgtgaatgggtttggaaacagtgttgttgctaccagagtgtggctgatgggacaggatagtgtgcaggggggtgaaattactaagtttagtcctggatgtgatgtttactcatcttatgaccttgga

SEQ ID NO: 45618 - DNA, 480 bp, Homo sapiens
cctcagcccttggctcctgcccagtgtttagggtgttggcggagacaaaggggaagagtcatcgcctgtcggggctaggatatgatgggtgagaggtgtcaaaccaaattctctcggtttggaaacggagaaaatctaaaaatgaggatgtgaggaaagagtccgctctcaaggcgcgttgtggtctatccgagccccgtcccctgggctccctcgggctggggtgaggcgggcagcgctacgcgtggggtaggaccatcttacgctgggaccccgccaaggagccccaggaagtaggtgaaagggcaggggcgtggctctcggggcgccacccacgctcttgaaatctgggtgattgcgagcggccgctcagcgtcccccacaccacagacccgcgccgccgacgacccagcagccgccatggctctgctccgaggtgtgttagtagttgctgctaagcgaacgcccttaggagcttac

SEQ ID NO: 45619 - DNA, 336 bp, Homo sapiens
ctgagacagggccactgagtctacaaggtcttttatcttggataaaatcattgaagaggatgatgcttatgacttcagtacagattatgtgtaacagaacaatggctttttatgatttttttttaacattttaagcagactgctaaactgttctctgtataagttatggtatgcatgagctgtgtaaattttgtgaatatgtattatattaaaaccaggcaacttggaatccctaaattctgtaaaaagacaattcatctcattgtgagtggaagtagttatctggaataaaaaaagaagatacctattgagaatgactcgattatgattacattg

SEQ ID NO: 45620 - DNA, 1326 bp, Homo sapiens
aaaaacaatcaaacaaaaacttaaaaacctggcttatcccctcccctagtctccagcctcttgctgttacctcccgattcctgaatctaccagaagccagctgacattggagcctcggaagcatgccctgcaagggccagcctcaggaggataatgcctagaaggggaaggttacagagtgatctaggggcagaaggcccaggactagtaccctatctgacccagaccctttctctggagttagtaattggtttttcttctaattcttgagtcagttttggttatctctattttccaagaaaatcatctattttactgaggtttttaaattagtgtaaaattatattttatcatgtaaaatctccgtgtttatagttaatttcttcttcttattctaattttgtgtatgcataagcttaaatatttttctgcatttgtgacaattgcctagggacaggcaattttatttaacatgttcctctgacccttgtccattctttgattaataaataggtctagaagctgatccaattcaggatcagttattttggcataagtccttcacaggcagtatgtacttccatcaggggccatgtaaacataaatgtcctttttgatgttaatagctattgttgactattgcctagatacattaggagttgcaaatgctgaaaaactaattttatcattctttatttgtttatcaactggaacaattctttaaagagaagctatccctcatcactatttgatcactcttaactgtctgttgacttgcatttttacccttttatttttacttttcctttatacctgacttcctttaccaaaataataatcttttctctaaaggtacagaccccagaatttttgcagagatgcttatgtaatttttaatttaatttttttggtaaacaatacaaaattcaaaaggtttaaaagggcatagcataaaaagtaatcattttccccctacctccagccactcagttctctctttggaggcaaccactgttacaaatttcttatggtagtttccagagatatcaaaactatatattcaaatgataaagcaaatgggttaaaatgacaataatgagtgaatctgggtaacaggtgtataagtgttctttatattgttttatttgtacaacttttgtaagttttaaagtatttctaagtaaacagtaatatgcacattaaataatatatattatatatatactttttgtttagtaactcaaatgatactaactgtacacgccgtcctgccccttgcttttctcattaaaccatattatcttgaggatctgtcccttaggaaca

SEQ ID NO: 45621 - DNA, 2300 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagttt

SEQ ID NO: 45622 - DNA, 4074 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatga

SEQ ID NO: 45623 - DNA, 3355 bp, Homo sapiens
tcggctcggacccacaccacctgagtcctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatga

SEQ ID NO: 45624 - DNA, 4020 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagcaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatga

SEQ ID NO: 45625 - DNA, 4020 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattgagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatga

SEQ ID NO: 45626 - DNA, 4154 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatgaaaaaaaagagagaaaaaaagaaagaaaagaagggggaggagcaaagaaatacacgagaagggcacaaaaaaaggaataaa

SEQ ID NO: 45627 - DNA, 4513 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatgaaaaaaaaaaaaaaaaaaaaaaaaaaaaaaaaaaaaagggggggggggtaaaatttccccgggggggacgccgcatgtgttttaaccgggtgatcccccggtttttttttttgtctagagggtgcgcctcattttgggagaggcttttaattttataatcgacaggggcacgggcgccgggctggtttttaacaccggtttgtgagggggaccaacggtccttcccgttggagaactcttggttggaaaggacccccttctcttcgggggcggtacaactatcttggcacccactcttcccttcagagagtttataaggccctctagagagaatctataaccattttaaggcgtcatagagtgttttaacaacggcgtaaaatatccccggcgttgaaaaattgtctcaccgagatgatcatttaaaaaattttttcgga

SEQ ID NO: 45628 - DNA, 3541 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgcgcagtctgctcccatcagtctagcttgatggtagataacacatttgcttcattgaagtaatctgaaaaaccaatcctcataagacctctcaattagaattcttaaatgacaatgttttctttatcatatatttgagagattgatttaaagaaaaataatgcttgactatctgaaataatattttaaccctatcataaaatctctgcctggtagaacagctgactgtggaagggtaaaatgcagagaaccagtcattggatctcccttctctacttggttactgaaatcttgaacctgtagaacattacttatcactgtgttcctttctgatgggagcaag

SEQ ID NO: 45629 - DNA, 2625 bp, Homo sapiens
ttttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatacgtatagacacggacacctcgtaatacagtaggccctcgatgtcacactagccgtcgttgttacccggccgtcgttttacacctggccgatcgttttacacagccgtcgttctaa

SEQ ID NO: 45630 - DNA, 342 bp, Homo sapiens
ccggcgaggctggggccgggggcctagctggcaacgccgggagagggaagcgtagcgcggaaaatcccagtgctcggccttcgaaatgcaccggctcattcagccccgccagctccgccggggactctgcctggccggcaaagaggatttagcgcggggatccgctctaagtactgtggcttggctaggggcgaggggcgcagcggaggagggacgtctcgcggttatgtaatgcaccggctttctgtgtccccagccaaaccgctctaggactgccggaccctccccgggaagagccatgacccctgacctcggcaagccgaggggagctcggtgttccca

SEQ ID NO: 45631 - DNA, 2802 bp, Homo sapiens
  misc_feature (38)..(38): n is a, c, g, or t
  misc_feature (47)..(47): n is a, c, g, or t
gactcttgagatcccctacctcctcacacagatgcccnactgaaatngaagtcaagaaatgcataaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcaagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatctt

SEQ ID NO: 45632 - DNA, 2467 bp, Homo sapiens
  misc_feature (38)..(38): n is a, c, g, or t
  misc_feature (47)..(47): n is a, c, g, or t
gactcttgagatcccctacctcctcacacagatgcccnactgaaatngaagtcaagaaatgcataaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcaagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgaagaagatcggaggaaatttagaaggaaagaagaaagtggggaattccaaagggttagaaggaattaactttattattatttccgaaaggtggcgggaattgcacaacaggaatttcttccagcttaaactgtgggaaaccgaaggaaaactc

SEQ ID NO: 45633 - DNA, 2972 bp, Homo sapiens
  misc_feature (38)..(38): n is a, c, g, or t
  misc_feature (47)..(47): n is a, c, g, or t
gactcttgagatcccctacctcctcacacagatgcccnactgaaatngaagtcaagaaatgcataaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcaagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatcttaaaaaaaaaaaaaaaaacacaatttgtggggcctcggcaccaaaaactttcaacactcttgggggggggccaggtgcatgactggcacacgtcccagaaaccggtcggcatggtggcttccccaaaagccgggcccgggtccgacaccggctaggctggctaacggacgc

SEQ ID NO: 45634 - DNA, 2773 bp, Homo sapiens
  misc_feature (38)..(38): n is a, c, g, or t
  misc_feature (47)..(47): n is a, c, g, or t
gactcttgagatcccctacctcctcacacagatgcccnactgaaatngaagtcaagaaatgcataaaaggaactgacacatctcagcaaagaaaactgaagggatttggttataagtggagaggatctcagcatatttctggaagatagaaagtggatgaagcatgataatgaaagagtgaagaacctttcagataaaatgtaagctgatctgaacaacataaccccaaagagacttgcgcacctgaaaagcttgtctactgaagaattactccagttgtaagattgagccctctcctactctcccccaactcttatgcacagaacacaggcagtctccactattgataccagttaaaaatttcttgttattgttgctgttgttgtttgtataaaggaattgaacaggctgcttgcagagagataagagttggtgctccagaaaaaaatttctcttctagtggaaataagtgcccctacccccagccggtcagctaattctctactgacagctgagacctcctactcaagtgcctgttgccttcaggtatagaagaggtttcctgaagaaacagacctaactgtacaacagcagaggaaacccatgccaactgttatacaagttaacagttatgttgattcttaaatgggaatggtgagttagaaattcccagacatgggcgatggggagggaagaggaataagaaaagtcacgaggtagaattaggggccttgaaaatatgacaaactctgagggaaacaaagacaatgtggaaagaataacttaattttaattccatctccagagagatttgaggtgtatttaagatgaaaaacaggatactacaaagaaacggaaaactcaggagttcaagaccagcctaggcaagatggcaacatcccgtctctacaaaataatttttaaaaattagccaagcatggtggcatgtgcctgtggtcctagctacttgggaggctgaagtgggaagatcacttgagcccaggagttcaaggcttcagtgagccatgatggtgccactgcactccagcctgggggacagagtgagaccctgtctcttaaaaagcaagaaaagaaagagaagactgagaataagaagatctctttgaaaataaaataagactgctaaaagtatttggtatacagtctggaaaataaagttgagggaatctctccagataaagagcaaaaagaaatagatagaaaaatataaagaaagaaaaaagacatagacaatcaatatgtaatgttaggagttcctggaagagagaacagagacagtgtaggtgaagaaataaaaagaaaaagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatctt

SEQ ID NO: 45635 - DNA, 714 bp, Homo sapiens
gccggtcacactagaggatcccccgccatttacaactatctatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaataaaaatctt

SEQ ID NO: 45636 - DNA, 441 bp, Homo sapiens
agtgccctctgttgtttatgtgcctgtcagaaatactggattactttaagctcctcagacacagtaagctctgccacacctcactgcctttgcacatcctgttcctcttcctagaatttccagctcctctgcttggaaacctgcacatctttcaagcatgagctgtaaggtcacctctccagcaaagtggtcctgaccttttcctgcagacataaatggtttttctcctggctccccaatgaattttattcatatgcatgcctcttttttaccagtcattccactgcagcacaattatgtgtttacaggtctaatgccctactatgcttaaagctctccaagtacaaggaccgtttctattcatctgtgtatgtctcaaagtacacaccagacactcagcggaatgaatggttgcacacacatttttctaaggttaactaa

SEQ ID NO: 45637 - DNA, 333 bp, Homo sapiens
gagggcagatcacttgaggtcaggagttcaagaccagcctggccaacatggtgaaaccctgtctctactaaaaatacaaaaattagccagatgtgttggcgcgtgcataatcccagctacttgggaggctgagacaggagaattccttgaacgggggaggtggatgttgcagtgagctgagatcgcaccactgcactccagcctagaaaacagagggagactgtctcaaaaaagaaaaaaaaatccaaatgttatcttttgaacatgtaatcaatataaaaaagttacccatgagattttttttgtaactccacaatttattttatttcttct

SEQ ID NO: 45638 - DNA, 298 bp, Homo sapiens
ggaactcctgggcccaagcgatcctcccgcctgggcctccccaaggtgctggaattacaggcgtcagccactgcacccagcccaaggtgcagagaatttaagtaacttgcacagatgacacagccctggaaggaggtttcaaacccaagaaaagaaactttcagaggcttggaagcccagccctgcccagcctccttgtgtcctgatggctggaagaccagcccagccctcaagaggctgcctggctgtgattagtgggagtcatcatgaggatgtccaaggacccactacaccccaa

SEQ ID NO: 45639 - DNA, 393 bp, Homo sapiens
ataatccacattgttacccaaagccacatgcagtgccgggagagcacagttgactgttttatgcagtatcctgccagaagatgctgaccagttctctagtaatagaaagtagtgagattgaattaagagcctatatagttcaccttgccattcgatatactttcactgtgatctgtaagcatattacatacaactttagtaacatattttctagtgagatcttggattgctgcaaggtggtaacagattctctgctttgcttcaggtgttagtggatctttgagtaattcctatggaatggagtctctgaaaaattggttttgatgctgttagcctaggggtcccacagcactgtatctgcctcaaataaatgcttatgtactagttacatta

SEQ ID NO: 45640 - DNA, 1233 bp, Homo sapiens
agagcttacaaacataccatgactgagcaaaatgtgtgggattttcttgtttctcttctgggaaagggaaaagggttaaaatagcttgagcaactattattcatgaaatgtttttaactaagtcactaacaaagatttgcctatgtaagctttgatttctataactttttttttttgaagcattcattgtgttaacacaaatgtagagctgtaatgtgaaacttcagggagccggggtaaaactccctttcagatgtcatcagctagttttgagtgatcggacacaggtcaaacttcatagtgcccaagctgggcaatagagacagattcccaccaccagtctgatcagctgcccattctctcgccgctcttaggggaaaaaactgtacacattagcaacttccccccaaaatctcttcttgctacccaaagtcatatttgatttttatcttcatactttttcatattataaacaacacattcttcatgatatctaagagatgaattatacaatttaacacataatttgttatacttagagctaagagattttcaatttcatttaattcaaatcgttcctttatcaaatgtggaaagtgaggtctagagaggttatatgccttacttatgagtatctgaaagtaacaaaaactttgaaaaggtttaatcataaaaccaaagttaacataatattcaactgccattttaattaagcattcaaactactctgttacagaagtgcaggttgagcatctgtaatacaaaactccaaaatgctccaaaattttaaatctattgagcacagacatgatgccaccagtgaaaaactccacacctgaactcatatgatgggttacagccacagctcagccaaaactttattgtgtgcacaaaattactgaaaatattgtataaaattaccttcaggctgtctacagtatataaaacataaatgaatgtttagtcttaggtcccatccccaacatatctcactacatatatgcaaatatttcaaaatccgaaacagttgtactcccaaacacttcgaattagggatacccaacctacgtttgtaaatatatctgtgtataacaagaatatgagcacttatatataaatgaagacgcaaaggaaaatgtccagaagaaaaaacagcaaacctttactagtcagggcaatgggcctggagagctaggggaggagcggtagggaggagttgtaaaagatgacttt

SEQ ID NO: 45641 - DNA, 327 bp, Homo sapiens
tttgaatccatttattacaaatctgcaaataccaattttctgaattcttttcaagatgaaatgagggctatccaggaagatggatgtatacagtactagtcaatttcaccaaaaaatagttccctatttggtgaatgggattaaaatacgagtattgatattaatatttagaaagcacagcatatggcacttcttccatttgaatttacaaatctttgtgaggtatcgtttgcagctctaatagccactcaaaccaagtatggacatcactctccacagaacgagattctcatgtcaccacagcacgtaccgtgctttccaaaccta

SEQ ID NO: 45642 - DNA, 198 bp, Homo sapiens
tgccttgtggcaattccacagctggctccctttaggctccatggaattgtacatctagggccacgttagagtgatcgaaaaaactagataaggataagtattttcttgttttaactttttaaatgttcttaagcttcgaaaattgaattgaatttaatttggccaacgttgtcaggaagggcaagcttataaaaagaa

SEQ ID NO: 45643 - DNA, 374 bp, Homo sapiens
agccattttgggtgatatccaaggtgctgtgattgttttcagccaggggtatgtttattcacgaatcccaaaatacttcctcactcctttgttgggaccacagagataaatatacagataagggactttgaaagaccattttattagtggggacttcagtgtgaaaaccgagtgttgaccctgggacctgggcctcttgtgttagagaacatctttatctacactgcccctaagctcagcacatccaaagtacacacacatcaaggtccagaccggagtcctggcctcagtctgacagtgtgtggcgggggcatgcatgcccagttgggacctgcctcccatgctgtttttgtgggagagcagcccactttaga

SEQ ID NO: 45644 - DNA, 417 bp, Homo sapiens
ctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactcctttgaattgtaaccagcaaacaattcacttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagt

SEQ ID NO: 45645 - DNA, 1541 bp, Homo sapiens
ccgcctcagtctcccaagtagctggggttacaggtgcacgccaccacgcctggctaatttttttgtaatttttgtagagacggggtttcactgtgttgcccaggctggtctcgagctcctgagctcaagcgatccacccgcccatgcctcccagagtgctgggattacaggcgtgagccactgcacccagccctcttagccattttgttaacctcatttcccacctctggaggtggtaggggcttcccaagaagatcacttggacctcttcaagtatggtggcaatattgctgggctgttggagagacttctgttatagaggctcccctcttgtgtttttcctcaaaggcaaggagtcatttttggtcacatgaggacaaagagaccagaccagtagtgcattctgttttgcatgggaattgtcaaggctctttcagttttaactgaaacccaactcaaactggcctaagtcaaaaacgaatttattcatctatgtaactgaaaagagtgggccacaagggggaggcttcaggctagctgcatctaggttttaaatcatgtgaacagatctccctttccccctcccccatctcttgactttgctgtcatctgttagtttcattctgaagcaggcttccaccgtgaaatagaagaggtggcaactggtgacatcatgagacgatgtgtaatctgagcaaccctaaccaagaacttattttccttagtagttccagcaaaaatccagagaggactatccttggccaggctttaccccatgtccacttctggagccaagaaagacagttccttctccaaggggaacccagggtgttgatactagaagatggaaatggatacagtaagatgctgccacagtgagatgcctcacccaggtctccctctgtcacttcagccaagcacatgggatagaaagtagcaggcggcctctggccctttaatggaagagggccatccagtcctctccagttaacatctagaccgaacacaaagcatccttctctcatccagaagacataggaaccctaccttcagggatgatttttttttaacagtgaaatcttaaaagtaactgtttcactaaagcctccagtatttactgaagactgtcagaatcatcctccatcactagatcttctccaccagtcatgttccctgagcagtggggtggcttgaaggtataaaccagagaggcccaagggagggatagttagcagacttctggtctttttctagtttgtgctcttctgttccaaggaccacaggtatgtcttcttctgtgtagttgttcactattgtttcaatgtgattcgtttcccacatttgaaaatagggggggattttactttaaaattcagatatctggctcctctttaggggaaaaaaaaaaaaaaaaaacctaagacgtaacaatactggacccacattccttcatggtagcagttgataagaggtggatagtgacttctcccttttgaccgggtgtggactttccaactcaccatagtcccagttggcctgct

SEQ ID NO: 45646 - DNA, 441 bp, Homo sapiens
caaaaagccaaaacaaaacctgaaacccttgtcaagaaggccattgggctcatctcaagctctagtctactgaaggcctgacctctgagtgttcctactcgcggactcagggcctctgttctctggtgtggtaatctgagttcctaatttctatcttagctgaatgttctgccatgaccactgacacgtccaactcacatctctttggagtcagtctctttcctatcgaggtgggtttcaggtcttgcttgcggctcagtttccttggcccaccttgtggctgtcctcctcccagctgccaccagtcgttcagtgtggccacgcagtttttttgcagaaggcaggtgaaccacacctgctcccatgctagcctcctcttccttttctcacctaccccagtgatttctttgtgctctgagagacaagttccatgttctccat

SEQ ID NO: 45647 - DNA, 469 bp, Homo sapiens
atgggaagtgaagaccctcccagagcctccagaaaggaagagagccattcagacaccttgatttcagccttctgaaacttggagcagagagccggctgtgtcaacctgaacctgggtttttaacctacaaaactgagaaataatgaatagtgatttttttttttaaagatggagtctagctccgtcacccaggctggagtgcagtggcacgaatagtgattgttttaagccactaaatttatggtagttttgttagggcagcaatagaaaactaatacatatgtaatatagcattttataaactaaaatgtcaggcaaatatgtgctcttataatttgatattgctatctattagagacattgggttaaagaatatactgaaccaatgttgtatttattataagaaagataagggtgggagatggaaaaaatgatgttaaactcatgaatttagtttgctttgcaaatg

SEQ ID NO: 45648 - DNA, 676 bp, Homo sapiens
atcaattaccaggtgcatttttaataacaggtcagcatttgaatggcttttatatttcagagacaatactcagtatcaaatatattgtacattataactttggaattctccctttcctttcggatttttctagtgagatggagtggctttctgttgtcttttacagccttcaaagctactgtttttaaattatgccacagacctgataatattctgaagagtattgctcctggaagactgcagtggagaatattgttttttcctattaattctcttacctgcctattctgggcaaccaaatcttgatcccatagaagtaaaacatactgagtagaggtggggaaaagttgaggaaatggtgtgatacagtcccatactcatagtcatatagttatttagtgaaagagctaggattaggactcctaattcctagattagtattctgtattctacagtaaaagagatatttactccatataggcaaacagtattcgtactgaagcatcttactatgatagttttcctataaaatttgttagttacaacttttagtttgggtttccctctccttgctgtaccaccatcttctccatcctgattacttcaagaaattgcactatagttgaacttttcttgagctcttggaattctggatcaaatttaacaagataacctt

SEQ ID NO: 45649 - DNA, 368 bp, Homo sapiens
ctcatttcctagtttaggtcaactcttaggtggcaatgcttaagctctgagggtcccacaccaaaatgaggcctgctccaaaatttattttggaaatttatttaataaattaaatttaaaaatttatttaataaattaaatttatttaagccttcgcaacagctttccaatttacaccaaaaggatggaaggaaaacttaagggtctggattattaaaagctagacaacctttattattgttgtttattctttctaaggctctgcctggtgataagtgtgtgaacttacccaagactatgccaaggatgtgtcttttctgctccaaccagaaattttagatgcagaaggaactttggagatctggccc

SEQ ID NO: 45650 - DNA, 450 bp, Homo sapiens
tctgccccctttcttactctggctctcacctagtcatgcttcaaaactcaggttagctgtcacatttcgggaagtgttttgtaattcctttattcatagtgtgctgcccccgttaccctgcaccatagtgcttaccatagtgcaccatagcactgaccgtagcgcaccatagcgcttaccatagcgcaccatagcactgaccatagcgcaccatacactgaccatagcgcaccatagcgcttaccatagcgcaccatagggcttaccatagcgcaccatagcgcttaccatagcgcaccatagcacttaccatagcgcttaccatagtgcaccatagcgctgaccatagtgcaccatagcgcttaccatagtgcaccatagggcttaccatagcgcttaccatagtgcaccatagcgctgaccatagtgcaccatagcactttccccagt

SEQ ID NO: 45651 - DNA, 1155 bp, Homo sapiens
tttaaataacttcatccctttccctctctgctgagcatttaaccatttaaggaagttcccagtttgcattagggaattatttaagcccagcccagtgacggattatttgggaggaagcaggagtgagtaaaaacattgtgtctgtgtatatattgcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctggaagcccaggcctgcagctgtggaactctagattttttcaggacacgtctctttgcccttgtttacatatctactggcacagccgaggctcccaaccgtcctcccagacacctggccacattagaaaggggtggtgggccctgccctttgtagaaagagtgggaccctttctggcctgtgattttccatgccagtgatgccaggcccctgcctgtgggactccacccaaagcaggttcacaccaggacacacctggcacctttggcattgcctccttgtgccctaagcaatctcccagtgttgcacccaggagcccatgctgggacaccagggctttccccttcctggctgcgctccagagttgacgtcagctccacacccacactgccaagacaaaccaaaaagatgctctgggctccagaaccaccatcctcctagggctccagagagtttgcaaacccaggctgcctccccttctgtccatccctcaccccccggcccccaaaactcctacccccaaacctggcactgccgtgatttagaggaaacaaggacacagcgggggctgccc

SEQ ID NO: 45652 - DNA, 488 bp, Homo sapiens
aacttgcattaggtgttttaccctttaaaatactgtgtccctggaaaagtaaaaatgagggttgagctattaaaaattgggacttgacccaggaataaatatttttaaaaatcattgtatctttgagaacacccatcgcccccctctggccagtcttccctcagtgcatgctcacactccgtttcttccagcccggaatctccatcgaacgccctcatttgcattctgagtgctgagtgctcccagacggagctgcttattaagtgcggctggctcttctctagtcaggccaggtagaggctctgggaggcccagtcagggggctgctctccccagcccccttcctgcctccctctggtcaccagagtcatccggcctctcagtgatgtatttaggaaacacgcctggggaattgcatccccctctctctttcggttcctgtgaggagccccaggagagcctgttctgcatttccttgcgacagaccc

SEQ ID NO: 45653 - DNA, 500 bp, Homo sapiens
tttttttttttaatcagctgccacattctctatgctaaagccaaatcatttaccatcacacctactggatgcatagggaatacagaagactatgaaaatcaccttaacacttgctctgaaaagagacatccctaaatttatgtcaattctcatttattagcctgcttatttaaaaaatcaatctagaatgactggctcatcaacagctattaattactgaatttgccctgacaggctagaattgacattggtgttatacaaaaaaaaaaaaaaaagatcaagtccttgctttttgtgtgctttaatttgacaagagagaaactaaagttcctattagatccttctgtttcctgcttaaaatgtatgacagttccccaaggccatcagctatttcttagcagggcatttgaggcctctgcacccagcttcgttcatcctttaaggtaggtctcacatggcatgaactctggatgtagctgccaactcagcttgtcattcaa

SEQ ID NO: 45654 - DNA, 462 bp, Homo sapiens
ttcctgacctccttccgtcttactttctcttgctagtttgtccatctctgtggattttttaaagtagatactagatacctagatactactaagaacatgatctttctcttcttgccacttggattttagcttaaagccaacttggaacatttagggtgtttccttcctaccactgtctgcctggtctcctagggaaagatgccttgtatcttgttctggtgtacagtctgcccatttaattggtaagtgtttattgtgactcttctctactgggctctggccccaggcctgatgcgaatagggcaggcctgtgaacagagcaaagacgagtcacttaggaggggacgagagaggccagcggtaaactaatattaccagctcagggtttatttgtcaaagcctcctttgctgtgaataaaaggttagatctgaattgggtctgagtcctggctttattaccta

SEQ ID NO: 45655 - DNA, 442 bp, Homo sapiens
aaccagctgtgggactttttgcaggttttttcaatctgggagtgccaggtttaccatttgaaaaaatggggaaaatagcagtatcaatttcatagggtagataggattaaacaaaataatgcattaaagccaaacttagccccataataagcactgagtaaataacatgtaaatggtaagcactgattaaatagtaggtactatcatcatcatcctctttttctaccacaaattttattgaagcaatttcttctcagtggagggataaacttgcagtaacaggagaaggaaagtaagtacaggaagggagatttggaataccaaaagagaaacatttcatacttcctagtttataagataatcggtctggcttatgttaaccaaatcaaaactctcataagcacccatggattaaacaaaaacaaaaagaaaagcaaaaatt

SEQ ID NO: 45656 - DNA, 480 bp, Homo sapiens
taatttcatcactattgagagagagttggctacagaactgtgcaaataagaccacagaagttttgtttaaattaaaggcctgcttttaaatttctttggtatttttaatttttgctgattccaaactcatttattcactctttaaacatgtattacaacaccaactcaactatgtgttgggtgccggtcagaaattttgaaatacaagaaggaaaagatagagaccctgattttataggagaatgaacacaccagaaaaccaatgaggacatacaatacaatgggataagaatgaaaaggataaacttgggtctagaagaaggattccagaaaggttcctgtgagagaaggaaaaacagggaaagcaatgctcaatcttggaaagaattttgaaggttgagtggaagttagcctgatggatttgggtcaaggagtgagagaatgaagaatgggagagtggtctgtttgtgggaacggtaa

SEQ ID NO: 45657 - DNA, 326 bp, Homo sapiens
caaggctggtatcaaactctgggctcaagtgatcctcccgcctcggcctcccaaagtgctgggattacaggcatgagccactgcgcctggccctcagtgacctttaagagtatgaaggagtcctcagataaaaacatttgagaagcacggaggtggaaatttgtctttggcctgggggcctggagtctaaatactgcattgagtggctgatctgtggttttcgcttaaaatacaggttagatcatttgtttctgtttgcattctgtcctagttgcttctatttattttttctctctttttgaatctgtgaaacattaacagggttc

SEQ ID NO: 45658 - DNA, 328 bp, Homo sapiens
tttagaaactaaaacatactaagtgactcgtgttaaaaagaaaaataaaggaaactaagaaactttgtcaaaacactacattttgtgggacacagttaaaacaattcataaaaaagttacaccattaggggacgggtgcagtggctcatgcctgtaatcccagcactttgggaggccgaggtgctaggatggcttgagcccaagagcttgagaccagcctgagaaacacagcaagatctggactccacaaaatatttttttttaattatctaggtgtggtggcacgtgccaatattcccagctgggtgacagagagagaccctgtctc

SEQ ID NO: 45659 - DNA, 293 bp, Homo sapiens
aaattctgtaaagtacacaatttccaaaaaattatatagctgaaactgtataacaagctttgggatcaaaccctactgaatcttgtcagaatagaactcaagaggtgggaatagtgcatggcttgtccaggagcatccacggagcatccttggacactaggtggggtgctctatagagggaatggagagccctgcccgatctagtgagttagttatgtggaggttggttaaaaaaacttctatatttgtttatttgcatgctactttacagttcttgaagtactttcaaattg

SEQ ID NO: 45660 - DNA, 416 bp, Homo sapiens
tgaactttcataccagttttatttgcaatggccaaaaataagaaataactcaaatgtccatcagcaagattagatgtttaaagtgtggtataatcatacagtggcatactattcagtagttaaaaggaataaactcttgatacacacaacaatgtggatgaacttcaagaagataacactaagtgagggaagccagactcaaagtagtgaatattgttggactccatttatatgaaattctagatcaggtaaaactaatctctagtgataaaaatcagaacattggttacctggggtggatggagggggaggaattgactagaatggggcagaaagggacattctagggagatgaaaatgttctaaatcttgactatggtggtggatccatgggagtatatatttgtcaaaactca

SEQ ID NO: 45661 - DNA, 662 bp, Homo sapiens
gccatacacttcagcagagtttgcaacttctcttctaagtctttatccttcccccaaggcatgcctagcacaggactcttgaacagtgatgcctcaattagagttgctagccaatagattgaagctatgttggcacaatatcctacatcctcccgatctactggctgagcccaaccccacctaagaaggacaataaagatctgtgttcagagtcatactgaatagagacttctggactctatagaacccactgcctcctgatgaagtccctactgttcacccttgcagtttttatgctcctggcccaattggtctcaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttgaacattccagcctctgtctcctgctctaggatccccgactcattaaagcaaagaggcttaaaaaaaa

SEQ ID NO: 45662 - DNA, 340 bp, Homo sapiens
gaacttgtagatagatcaatgtaaattatccagtgtgaagaaagagaattaaatatttattaaaaatgaatggagcttcagaaacttataggacagtattccaacatacatataattggaatcctgtatgaagagagcagatagctgtaaaaaatagttgaagaaataatgactatattttttctatatttggtgatggacctgaatttcaagaagctaagtagatcctaaacatgataaataccaaccaaatgtaggcatatcatggtcaaacagctgaaagccaaatacaaagagaaaagtttgaaagtattcatagagaaatgacacatgttatatg

SEQ ID NO: 45663 - DNA, 478 bp, Homo sapiens
aatcatggagttgcttattttcttttcatttggatagtttcccatcatttatgaaagaaaagctaagttctcttcaggcagatattaatgttagtaaaatagagtctcatatttacctgatggtcaggatggcacataagttggtgattagattttagatttttatatttagttgtacctgatgtgctttgcggtcttagacaaaggcttgccttctctttagatctattggaattagaagataaaagcactttgttttttagagatggggtcttacactgtcatccaggctggagtgcagtgatgtgatcgcagctcactgcagcctcaaactcctgggcttaagcggtcctcctgcttcagcctcccaaatagctgggactgcaggcacttgccaccatgcctggctattttttttttttttttttgtagagacagggtcttgctgtgtttccctatctggtctcaaactcctggg

SEQ ID NO: 45664 - DNA, 417 bp, Homo sapiens
ctttctttaaaattatttttcaaaaccatcctttctagttaaggggagcataaaggcatcagaaacccacttacagcatttcatttctgatatccctcaacacagaataaacaatgaaactgatttcagtttgaatggtctctgaaatatttcctttatgcttggcagccctatgcaaaaatttccgcctgttgcaaattaaaagtcttcgagttgcaaacccccctgaagaaaggttctgataatagggacgttgtcagacccttaactaagccacacactgctgggagcctccggaataactttaatgtagttgtagggaagggagtcgttggcagggatgaggatccctgcttgactgctctctttcctgacgaggaagaaaaggacagtgatcaagcacagggtctcaaagga

SEQ ID NO: 45665 - DNA, 825 bp, Homo sapiens
cttccaaataaggtgatagcagaatcgtgttttatgccaaacacagtaaaactttccctcttacaaccaaaaaatcactaatttactccccaaaagagaagacaagtctctattcatctttaggtgccattcatttctcttcaagctccttgatattgcataacttaaatactgaagtatgagtctaaatactgttaacatattttacattaaatggcaggaggataggagagaggaataaaaagtttgattcatgtatacaaatacagttctatcaaaataagaaaaaagcatttataactgttctagtcctcatttctgcaactgatcacagggtcattgctggtatttataaccactttcttctgatagccagtccctattctctttgtccttggcaaacactttgtccttaccacataacatgaccaaaacctggaagtggaactttcatatactgctgtgggaatgaaaaagtggcacaaccccttcgtgaaatagtttgacagtttcctaagtagtttaaacacctcaactatatgatatatgtgtgtttagctttgagagtgaaaagcatatgtccatacaaagacttgcacacagatgttcatagctgctttttggtaatagttaaaaactattagaaatattcagatatccattaaccagatatccatccaaaaaccaaatatccatcagcaagtaaaaagatgcacaaactgcgatactaccatataattgaatattactcagcaataaaaaggaatgaactattgaaaccctctgcaagatgatgaatatcaaaagttattattcggagtgtaa

SEQ ID NO: 45666 - DNA, 429 bp, Homo sapiens
ataatattgtcgcaaaatgtgtagttgcgtgactctaagcacctttggttaaaacccctctattttgatttttatgaaaaaaataatgttatttgggctaaatctatggaacctggacaattaaaaaagtgtttattatgtgcccattcagatgtgatttctaaatgtactctttttagttactctttccaacaactttgcagtagcttaaaaatgttattcttttcaattgtttgaagctcagagaaggcacagaacataaccaattaagtgacagaaccatgatttgaacccagatctgtctgacttcaacactaattctcatagcagggagggaaaatactggaatactgacaagccgggataaaatgctctcccaatatacccatatattttggttccatcttgctgctctgtatgtgtatatat

SEQ ID NO: 45667 - DNA, 466 bp, Homo sapiens
agccaccgtgcccagcctacgttgttccttttaaaccaaactttaataatacggttgctaatgaaattaagtaaactacttaggaatgattgcttcaactatttattaagaggaaagagaacctgttcaatggctgctgtatactaggcactgtgtaaaacgctgggagagtaaagatgaataagacagtgctctcctaaaggagtaccatgtcttgttagggggatgctaatagactaaaggagagcacatttagcttaagcttttctttggatggttttttctgcactcattatgtaccagacactatgtaagttactgggatctaaagatgagtgacactgatcctttaaggaattcagggtctagtgaggatgctgttaatgaatgcttatagtacagtgccacgggtgccataacagtagtgcaaatgctgggaagtgtcagcaaatcagttccgccgcca

SEQ ID NO: 45668 - DNA, 3291 bp, Homo sapiens
accacttccttctttggaatgctccctttcctgaccctactttcctgatttttctgccacttctttgctctttctcagtttctgtggagttgtttggtaggtcagtctagcacagactggatgccggtctctgccgccacctccgttatttcagtgaacacctgtatgccagtgagttcctttgccataccaccttaatgcaccaacttaaaagcacagattagagtggagcattcacatttattactgcaggcttctaggaaagcatattaaaggtctctggtccttctctcacctcccttgttcctcctccaagcccagtgaggtaggaggaattgctaattagattagtgagattctaaggtgggtcactcctgtttacttatgagttgctatttatgaaaagatggcctggactgtgttccctcttctgctttctcctcttccgggtcttggactggtaagggggcctgtgcccaaaaggggctcctccacctaatgctgtctttaatctgtggctttctgctgctggttaattttttaatttggcttcctcaagcctttttggccttgaacttcatgttgatttttatcaaagaactttttattggggcatcagcactagccctatgaatacagtgaaacttggggttccactttcatcagatgtgaccctgtgtgttcctgatgtctttgaatcactagtttctgattcaaaatatggggtaggtggatctgattagtagtcatatgcctgtgtcctggctaggaagtcagaatgaggttatctggaaagttgagcttcctcacacatgggaaggtacttcagatgctggacagccaataagaataacaaaggtccaccagaaccattgccccagtcactgattgaacaaacatttactgaacactgatgaagcgaagtcctcctcagggacctcttagggaagagggtaactgccctaaagcaggatactcctgggctccttagatatactatccttgaaactattaggcccctgtccagagtacctaataataataatggcaaatatgtatttggtggtctgccatttggaagcaacatctcacttattcaacaactctaaaggtaggtacttttatctccattttaaaacaatgaaatacacttacagttacagacaaacttgctcgagtcacatatctattaagtgtcagtcaagattcagattcaagtctgatgttaaagagtgtctgttcccaatcaatacctctgctgcctctttttacaaactgaactgttggagggcatgtacatatgcataagctgtgggccactgggccatgggccagtgtctgatgagacctctttattgacttgtttgtcccggtgggctgtttctctaccaggcaactgtgaatgggctcatcccttctctgtgcgtacatgattgaaaggagatagccggtttctgtgacatcctcttataacaacctagttttgttcttgagagtgaccagagcaagagaaaagtcaatgaaattttgcagatcttgcaaacctgtggcaataagaaggtattatcctttctgtaccaaggcacaactgattcctaagcgagggggatatgtgttctgagatgttaatgttagtgatagactgttttcaacaccttggtaaacatttcttttgactgttagcaaaagctgccttaacagtcttggcttttagaaatgccccttcattcattagatgtgtatggaacacatcttatgccaagcactctgctaggagctgggtatacagagaagaaaggcattcctgctctcatgatgttcatggtcttctgcggaagagaccagaaaaaaagtattacaatgtagaatgaaataagaatgacagggtattttggcagcaaggaggagggcactttaactcaaactgggcagtggaagaagtaaaaaaaaacattgaaagaaatcctgaaggataagcaggagttaagaagagtggatgaagccctccaagggtaaaagcatggtttattcagagcactgcaagtgttttagtatggcccacatgtaaagcttacagaggaacaaagagagaaaggcaagagccaggaagtgaagggtcctgtgtatactggcttacttgttgagttggagaactattgccgtattcctctgctaagctcagggtgcattcgtggaaaccctactgcaactggcccattgtgcatacaaagctggaactgagatgtgaacagatttgcattgccttgatcaccttccgtgggaaatatagctaggcccacttattggtaggagctactgacatgttaaaactaggttaaactgaattggaagtaatggtgtatttggaatcatggctgactgattccattacatgttctagcatgataccagtctgaggttattccccttgaaccaccgacttagtagagtttaatgcacaatgtgatggtcttagttccttgtactgttcttcagtgtcaaagttgttcaactaccagttaagttttttgggctttgtttctcagtagtgacaataaatttgtgttgatctatttacaccttttggactgaacaccttagcaatcattgatattttaagcctacaggaagtgcccatgggataaaaccaatctgctggctcacactaagttctgatcccatgattttggtctcattaataccgtgctataaataaagttagctaaatcttttgaaactgcataaaagtgaaataattatgagttttgggccaacatttttcctgaacagcttctgactgaccagcattttaaattaggcgatgcagtctagcttttgtacatagaaataagaaagtgacttatgttccattattaaaatagtatagggaggacaggtaaattactaatttttcattgctcatagtagagaattaaggtatattgactagtgaaatagaggattatggggatcatatgaaaatatgattaaagagattatcactagaagaaaaattcagactgctaattatgagaaaaaacatgtatgcacaaccaaacaaatcacaaaaatgaaagatgtctaaaaccatagaataggaacaaatgtacctgtcatattaataaaagtaaacttatctgtagataaaaggcaaaaatgtcagcaaacactaatttcacgtcatctcctcccacccccacaaccagtaccaatgcacatagtcattgtcatgttttagactttacataagctttcctgtattctgtatataaaaaacaaagatacttcaaa

SEQ ID NO: 45669 - DNA, 354 bp, Homo sapiens
taggtcacaagctacgttattaggatcaatcatgtgaacaggacacgtacaattatagatttgagaccgcgtcgaccctatccaagaataggagatgtatttccatttattcaagtctattttgtgccttttagcagtgttttaaaattatccttgtgtaggttttgtgcatttcttgctaagcttatccctaagtatttaatttatttgctagtaaatgagatttcctctgccattatgtcttctaactggttattgctctctatataaaagctactgattttgtatgctaatatatcttgctaccttacctaatttttttaaaaaaataaacaacagaaatttaaaaaactt

SEQ ID NO: 45670 - DNA, 5367 bp, Homo sapiens
accacttccttctttggaatgctccctttcctgaccctactttcctgatttttctgccacttctttgctctttctcagtttctgtggagttgtttggtaggtcagtctagcacagactggatgccggtctctgccgccacctccgttatttcagtgaacacctgtatgccagtgagttcctttgccataccaccttaatgcaccaacttaaaagcacagattagagtggagcattcacatttattactgcaggcttctaggaaagcatattaaaggtctctggtccttctctcacctcccttgttcctcctccaagcccagtgaggtaggaggaattgctaattagattagtgagattctaaggtgggtcactcctgtttacttatgagttgctatttatgaaaagatggcctggactgtgttccctcttctgctttctcctcttccgggtcttggactggtaagggggcctgtgcccaaaaggggctcctccacctaatgctgtctttaatctgtggctttctgctgctggttaattttttaatttggcttcctcaagcctttttggccttgaacttcatgttgatttttatcaaagaactttttattggggcatcagcactagccctatgaatacagtgaaacttggggttccactttcatcagatgtgaccctgtgtgttcctgatgtctttgaatcactagtttctgattcaaaatatggggtaggtggatctgattagtagtcatatgcctgtgtcctggctaggaagtcagaatgaggttatctggaaagttgagcttcctcacacatgggaaggtacttcagatgctggacagccaataagaataacaaaggtccaccagaaccattgccccagtcactgattgaacaaacatttactgaacactgatgaagcgaagtcctcctcagggacctcttagggaagagggtaactgccctaaagcaggatactcctgggctccttagatatactatccttgaaactattaggcccctgtccagagtacctaataataataatggcaaatatgtatttggtggtctgccatttggaagcaacatctcacttattcaacaactctaaaggtaggtacttttatctccattttaaaacaatgaaatacacttacagttacagacaaacttgctcgagtcacatatctattaagtgtcagtcaagattcagattcaagtctgatgttaaagagtgtctgttcccaatcaatacctctgctgcctctttttacaaactgaactgttggagggcatgtacatatgcataagctgtgggccactgggccatgggccagtgtctgatgagacctctttattgacttgtttgtcccggtgggctgtttctctaccaggcaactgtgaatgggctcatcccttctctgtgcgtacatgattgaaaggagatagccggtttctgtgacatcctcttataacaacctagttttgttcttgagagtgaccagagcaagagaaaagtcaatgaaattttgcagatcttgcaaacctgtggcaataagaaggtattatcctttctgtaccaaggcacaactgattcctaagcgagggggatatgtgttctgagatgttaatgttagtgatagactgttttcaacaccttggtaaacatttcttttgactgttagcaaaagctgccttaacagtcttggcttttagaaatgccccttcattcattagatgtgtatggaacacatcttatgccaagcactctgctaggagctgggtatacagagaagaaaggcattcctgctctcatgatgttcatggtcttctgcggaagagaccagaaaaaaagtattacaatgtagaatgaaataagaatgacagggtattttggcagcaaggaggagggcactttaactcaaactgggcagtggaagaagtaaaaaaaaacattgaaagaaatcctgaaggataagcaggagttaagaagagtggatgaagccctccaagggtaaaagcatggtttattcagagcactgcaagtgttttagtatggcccacatgtaaagcttacagaggaacaaagagagaaaggcaagagccaggaagtgaagggtcctgtgtatactggcttacttgttgagttggagaactattgccgtattcctctgctaagctcagggtgcattcgtggaaaccctactgcaactggcccattgtgcatacaaagctggaactgagatgtgaacagatttgcattgccttgatcaccttccgtgggaaatatagctaggcccacttattggtaggagctactgacatgttaaaactaggttaaactgaattggaagtaatggtgtatttggaatcatggctgactgattccattacatgttctagcatgataccagtctgaggttattccccttgaaccaccgacttagtagagtttaatgcacaatgtgatggtcttagttccttgtactgttcttcagtgtcaaagttgttcaactaccagttaagttttttgggctttgtttctcagtagtgacaataaatttgtgttgatctatttacaccttttggactgaacaccttagcaatcattgatattttaagcctacaggaagtgcccatgggataaaaccaatctgctggctcacactaagttctgatcccatgattttggtctcattaataccgtgctataaataaagttagctaaatcttttgaaactgcataaaagtgaaataattatgagttttgggccaacatttttcctgaacagcttctgactgaccagcattttaaattaggcgatgcagtctagcttttgtacatagaaataagaaagtgacttatgttccattattaaaatagtatagggaggacaggtaaattactaatttttcattgctcatagtagagaattaaggtatattgactagtgaaatagaggattatggggatcatatgaaaatatgattaaagagattatcactagaagaaaaattcagactgctaattatgagaaaaaacatgtatgcacaaccaaacaaatcacaaaaatgaaagatgtctaaaaccatagaataggaacaaatgtacctgtcatattaataaaagtaaacttatctgtagataaaaggcaaaaatgtcagcaaacactaatttcatgttataagattcagaaaggttgagcaaaagtaaaccaagcaaacacaaacaagaaaatgagttgtagtctgcatatcaggcaaggttgaacttagggaaaaggaaccggaaaaaaaaaaccaaaaaaaaccacgacataatgctaaagggtgtgactcacgagataatgtttctagatatctgtgtaccaaataatggaaaaccatttatgtattggaaaccataggagacacaggaagaaacaaatacaatgttagttggatattttaattcaattctgtcaattcatgacagatcaagtggataaaaaactaggacatgggatgatttaaataagatacagaagatctagttgatgcatattagactttaccctaaaagtggtaactacacttcaaagtatccatgaaacatttccccatttgactgtgtattagagcgtacagaaaacataagtttcagaacagaaaaaaggaacaacagatggcatttgctgataaaaatgcaataaacttagaatttgaggataggtggtcagaaaaaaaaatgcaataaattaaagccagaaaacactgctcatctgcaatccaaaatgtttttaagctcttcaactattcttgggttgattaggaaatgcaaagtattaaaaaaacatttcatatctaaaatataaacttgttcctctgagatacaaataaaacagtgctcagaggaaaattcattgccctaaaatttatgtattaaaaaataagataaatgtcatataactcaaaatattaggaaaaggaatcttttaaaggcaggctaaaagaatcaagaaaaattaattagaaaaatgaggaaacaaagctaatttttaaaatatgtagtaaaatatgtaacattttagctaacattacaagagaagacaaacacaaaataagaattaccaagtattgaataggtaagagtcataaaatattctttgctcaactgtatgcaaacaatttaaaaacttggattaaatggataattttccaggaaggtatagtttgccaaaaaatgacatcaaaagaaatctaatataacaattgtcatagaagaaatgaagtaagtatttcaattagcatgacagactaaatacttttaaagacccaatgaaaacaaagaaatgcatttggagaattaacagaaactttttgtaacaccaattttttattttacattttaaagcatggaatggaatttattgtaaagacgtgtattttatagaatccaagcaaaagctcaccagccagagataaagtgaggccagctcagggaatgtgagcagtggcgatttattccctctggtgttccatgttagcctgacacagagccccctcttcacattctcaggggctcttgatccaaaaccttttttaaaaaaaataattttagacttaacagaaaatctgcaaaaatagatttcctgtgtgcccttctctcagcttcttctaatgttaacttacataccaatggtacaattattgaaactaggaaattaacattggcacaatcctattaactacatactttatttgaattgtagctgttttcccagtaatgttgtttttctggttcggtattcaatccaggatccatatgtacttgggtctttctgggttttctgttccactggtctacttgtgcatggtaccacactgttttaattatagagactttatagtatgttttaacaactggcaaggctagtcccccttataatttttcctattgtgcttctggctattcatacatgtttgtttttccatgtgaactttagtatcaacttgtctaaattcattttttaaggtacattggtattttattgatattatatgatattaactgatttagagagaactaacatctttaaaatgtggtgtcatcctatccaagaataggagatgtatttccatttattcaagtctattttgtgccttttagcagtgttttaaaattatccttgtgtaggttttgtgcatttcttgctaagcttatccctaagtatttaatttatttgctagtaaatgagatttcctctgccattatgtcttctaactggttattgctctctatataaaagctactgattttgtatgctaatatatcttgctaccttacctaatttttttaaaaaaataaacaacagaaatttaaaaaactt

SEQ ID NO: 45671 - DNA, 2575 bp, Homo sapiens
ctcacccaggacccttcagagagtacgagccagggtttgagtgaagggcctgagccaagcacatgcatggtaggcactcaaagaataattgtcatgatcaggtcctttttacactgcttactagtggcctttaagcctcagtttcctcacagttgccttgagtgagtgtcaagtgttgtagacctctgcaaaattcataactgcttaagaatattaggtatgggtagagtaggcttggaaggaggattggtttgcagaatccctttcagagacctgtaatctaatttctcacattagggctaatactcctgggacccctctcctctccaattgcataaaacaggttctgaccagaacagcgaggcaggccagacctcagaagcagagggacgggcttaatctaacaggagtttatcccatgtcctgcatccactgtaccctgtgctgggtttagaagtagcttcactgtccaagcttgtgacccagtgcccaagcccgagatgggaaacacatttgttttggctgtgtgtgtgtgtgtgtgtgtgtgtgtgtgtgtgtgtgtgttttcaaacaagccaagatttttactttttgagttccattttgttgcccaggctggtctctgaaacttccaggctcaagcgaatccccctgctctcagcctcccaaaatgctggaaattacaggtgtgagctaccatgcccatttatttatttatttatttatttatttatttttgagacagaatctcactctgtcatccaggctggagtgcagtggtgcaattgtggctcactgtagcctcaacctcctgggctcaagtgatcctcccaccttaacctcccaaggagctgggactacaggcatacaccaccacacctggctaattttttgatttttaaaaaatgttttgtagagacggggtctcactgtgttgcccaggctggtcttgaactcctgagttcaagtgttcctctggtctcagcctcccaaaatgctgggattacagatgtgagccacctaacctggtctttttatttttttaaagagccaacatttaaataaggagatttcacatcacagtcgatttctggggcttggtttgttgttgttttttttgtttttttttttttttaattgagacaggatcttgccaggttgcagactggtcttgaactcctaggctcaaatgatcccctcctggccgggcacggtggctcacgcctgtaatcccagcactttgggaggcctaggtgggcggatcacgaggtcaggagatcgagaccttcctggctaacaaggtgaaatcctgtctctactaaaaatacaaaaaattagctggaaatggtggcaggcgcctatagtcccagctactcaagaggctgaggcaagagaatggcatgaacccaggaggcagagcttgcagtgggcggagatcctgtcactgcaatccagcctgggtgacagagcaagactccgtttcaaaaaaaaaaagaaaagatcccctgccccggcccttccctcccccacccacctcggcttccgaaagtggtaggattacaggcgtcagtcaccacacccggcctgctttattatttatatcagaagatgctgcaacattggatttttatggcagcagttcgttgagtagtggctgtcctggacataggaacagggacactccctcttgcatccctgactcagcacgtttcatatgtgttacttgcctgtcccctgcagaaaagtacttgaggttacagtctccatcccaccccactgtgggtgagaaggacctttccatgcagtgaaggcacttttcccctttccttcaccccttcctgttcccttctctgccgttttccttcttctcccccagaactcctctgtgaaatacctggcctccttccctgagcctccctgtctccctgccaccccatctccactccgtgctatgacatcaccccgtaatttgaagctcctttccctatctgaagggaggcagagacagagtgcacaggctcaactaggcaaggcagacccttgcatgcctgggtcagaggtcagggtctctggcacacattcctcccagagcaactgtaggaagcaagccagtacagaggtactctaagcgctagacaggacggggtgggagtcggtaacatcgtctcctctgggctggccctgcttctgcttagctctgggcataagactgactccagtacagtcacagttatgtctctgagctcacccagtcctgggttccaggttcccagctctgagcctggcgagacacacacaggctggtgctgtgggatgtcttggtcaggtgatctgcttgccttgacctcccaaagttcagggattacaggcgtgaggcaccatgcccagccagtccctgtcttcaaatacagtcacactgggggttaaacaatgtataaatttgggggcgatacaaacattcagtccataacaccccctataccccaaccctaggcaaccactaatctacatcttatctctacagatgacctattctggacatgtcatataaatggaatcatacaatgtgtggtca

SEQ ID NO: 45672 - DNA, 909 bp, Homo sapiens
atgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggt

SEQ ID NO: 45673 - DNA, 990 bp, Homo sapiens
atgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagttaaaaaa

SEQ ID NO: 45674 - DNA, 719 bp, Homo sapiens
ctatttactctctcttctagtgtctgtaaccattagctattgctgcctgcacttaaaacacacacacacacacacacacaatcataaaaaacctgtggtatccaaaaacattaatttctcatgcagctgccgggttcctctgatctcagctaggttgcctggggtgacttgggtgtctcttatcctcttcctgagggctggccctggcatgtctgctaacatcccattggtcaagacaagtcacatgctcaaccccgggtatgggaaattatgctttgccctcggtgggaggacatcacaaagttagactgcaaagggcacacaggtcaggagaacggagaagggcatttaaactaaggatgctgcttttttacagtcttcagagacgatgaacctcctgtcacaggaggtatgcaaacagagaggtgtaggcttggtggtaaaaagggatcaagcgtggatatagagttgggataaattaatgattcccaaatatcaatcatttctataacatagtcataattttccccatgaacgtttattcatttaatatagttccttaaatcatctaagtattctttttttataagctatatttttattattaaatgacttgcttgtaaactacacttgagaccactactttatctagaaaactgtatcatttgccataaagagaaggctttattactctaaaaataaaatgaaattaaaatgtt

SEQ ID NO: 45675 - DNA, 502 bp, Homo sapiens
gacacttcctcctttataaagtattccttccctcttccttcaaccttccaaccttcatccacatggactgtcctctctgtgccccaaataacttaccttaggcacattagcaatctctcttactagagtataaactccttgaagacaggaaccactttatctctctccatattctcctaacagaggactaggcctgtagtggtgtaagacaggccttcttgcatgaatggaatctcaggtcagtctcacctttattctcataagagggaatggtgtgtcctcactcttttctcctccactgaaagctgaattaggaattatttctctcctgacctctgacctaaatctatacaggtctgtcctgaagccacatccacaagatgatggggtgaacaaaaataaccacgggagctgagtgacatagcggaatattcacgcctgtcccggccttcacatgggcctggaaatttacaggaatgtatagctgtgctgttgctgagct

SEQ ID NO: 45676 - DNA, 593 bp, Homo sapiens
cacttcctccctgaccacaccctcactgattagagccccatcaccaggcctcactaactagattcccgctgccaggcccacaatgaccaggactccactgacgaggaccttactgacaaggcctcactggcaaggcctcactgacgaggtccttactgacaaggcctcactgatcaggttccgccgatcatgacctcatcgtctggtcccacagacgaagccccactgaccaggcctgcagggaataggcagccagtgaccagggcccctgctaaccagggactgaggtgacaagatgcccctgactgggaccctaatgactacgccccactgaacaggcacacactgctcagatccccgctgaccaggtcaccccgtagaccagtgctacaaaagccaccaatgatcaagtcctctctgaccaggcccccactgattaagttccacggaccagcctgcctgaccagggccccactgacaagcgtctctgctgactcggtcccaaggtctccactgaccaagtcccacagcccagattggcactgaccagacaccaaacatttgtctaccactatcaacccactcaccaagac

SEQ ID NO: 45677 - DNA, 493 bp, Homo sapiens
tcatatggaaaaactgaggctcagagaggttaaacaatttgttcaagctctctcaactatttttctttttttttttgagacagggtctcactctgttgcctagcctggagtgcagtgaaatgatcataactcactgcggccttgacttcctgggctcaagtgatcctcccacctcagcctcccaagtggctgggactacaggcactcatcaccatgcctagctaattttttaattttttaaataattttttgtagaggcaggtcttgctgtgttgcccaggctggtcttgaactgcaggcctcaagcaatcctcctgctttggcctcccaaagtactgggattacaagcgtgagccaccatggctatcctctctcaactgttaagaggcagggccggcagggtgcggtggctcacacctgtaatcccagcactttgggaggctgaggcaggcagatcatgaggtcaggagctcgagaccagcctggcgaacat

SEQ ID NO: 45678 - DNA, 750 bp, Homo sapiens
cactacacccagctaattttgtatttttagtggagacggggtttctccatgttggtcaggctggtcttgaactcctgacctcaggtgatctgcccgcctcagcctctcaaagtgctgtgattacaggtgtgagccactgcacccagcctcatttttttcttttttttgggggacggagtctcactctgtcacccaggctggagtgcagtggcgtgatcttagcacagcctcaacctcccaggctcaagccatcctcccacctcagcctcccaagtacctgggattcgaggtgtgtgcctcgaggtgtgtgcacgtccagctaattttgtttattttttgtacagattaggtcttagtatgttgcccagggtggtcttgaactcctgggctcaagcgatcctcccacctaggcctcccaaagtgctaggattagaagcatgaggcaccacacccagcttactcatgcaagtttctcctgagtgtcttcctcaggtgggattgctgggtcatagaaattgcacgtgttcagtgttttttgtctgtttgttttttagacggagtctcgctttatcgcccaggctagagtgcagtggcgcgatctccgctcactgcaagctccgcctcttgggttcatgccattctcctccctcagcctcccaagtagctgggactgcaggcgccacatacggccgtctgtactaaaaatacaaaaatagcggcatgtggtgcatgctgatccacctaatggag

SEQ ID NO: 45679 - DNA, 830 bp, Homo sapiens
aggattccccacctagcagagtagggttaactgatcatctgcctttccctaagccacaactctttcactgtaacccacactttctcctataggcaagtagagaagggcatgaaatgtgtcatatacggatgaaggaaataatgaattatttctgtgttagtcatcttgaaaatagatgatactgtgttgttatatttttataatgtctttgaacaatggcactttaggaaatctggaataaggtagaaaattactttttactaattataaaaagtaggctgggcctggtggcttgtgcctgtaatcccagctacttgggaggctaaggtgggaggatccccttgagccccccggaggtggaatgtattagtccattttcacacctactcctaaagaactgcccccggactgggtaatttataaaggaaagaggtttaattgactcatagttcctgcatagctggggagaccctcaggaaacttaaaagtcatggcaggaggcaaagaggaagcaaggtacccttccttcacaaggtggcaggaaggagaagtgcgtgtaggaggaacttgtcaaacacttataaaaccatcagatctcgtgagaactcactcactgtcatgagaacagcatgggagaaaccacccccatgatccaaacatctcccaccagttcccacccttgatacaaggggattatggggattacaattcaagatgagatttgggtgaggacacaaagcctaaccatatcacagaggttgcagtgagtgcagatcatgcccctgtactccaccctgggtgacagagcaagaacctgtctctacataaat

SEQ ID NO: 45680 - DNA, 432 bp, Homo sapiens
cagcacagtgagagcgggtgacagcatgagaaaaatggatgtgttcttccatcactgctgttctcctctctgtttggattagacaaatggcacatacccaaggggaactagggacaatgctctgaggacagtaaccacttccatacagccctgccagattcatgagagcaatggtgcatctgctttttgttgccattgttgttacttaatcttgtcatggacagattatcgtttctgtggcatttcttttgtgggttctcactcaaattactttctttatcatggctgtgctggattgtctgttgggcaagtcagcaccatttaccccttctgcaccttgactgatatattgggtttctgagaagtgtgcatgttggccttttgtctccccttgttccataccaccaaatataaaatttagataccctgaaa

SEQ ID NO: 45681 - DNA, 788 bp, Homo sapiens
aagcattttcacagatattttatttctagtatttattcaagttaatttgtctttcactgtaggagtcagtagagtcagaaatttcccttcatacattttaaaaaaagagtgcttccaacctggtgaatcaaaacacagattccatactgtgggatgaatccacaaactgcaaaatattttcacagataggttgtttctagtatatacccagggatatttggttttcactatagacgttaaagaactcagaagtgtctcttggtagattctacaagaagaatgtctccaacctggtaaatcaaaacagagtttccattctgtgagatgaacccactcatcactaagcattttaaagataccttgtttctagtatttattgcaggatttttggtttttcactataggcctcaactgactcagaaatatcatttcttagataattcaaaaatagtgtttccaaccaggtgaatcaaaacataggttccattctgtgagaagaacatacacattgaaaatcattttcacagataatttgttgctagtatttatcacagcatattcggtttttcactatagtcatcaatcaactcagaaataccctttttcatagattctacaataaaagggtttctgacctggtggatcaagacaaagttttattatgtgagataaattcacttatcacaaagcgttttcacagatatcttgattctagtttttatcacaggatattcagtttctcactgtagaggtcaattggccgaggaatgtctgtttgtagattctga

SEQ ID NO: 45682 - DNA, 339 bp, Homo sapiens
ggtgagagaggtcagacagctagcatctctggcagcctggcagttgcaggagggggcccacaattacagacctaattgtgtgaccacaggcaggtcccgccccccattgatttggagctggcactgcgggctttgccagggctaccatccagagagcctgtttgcacctgtgtcaaggcgagctcaggaaacctaattagctagtttggtgttttataattaggtcctttaaaagaattcataggtggtgataataagcccatttagaaatctattaagctttgggggaagttgaatagaaaccttgtaactatgtgcacacttgctttctctttcccc

SEQ ID NO: 45683 - DNA, 415 bp, Homo sapiens
acacgggaggcggaagttgcagtgagctgagatggtgccattgcactccagcctgggtgacaagagcaaaactcagtctcaaaacaaacaaacaaacaaacatacacaaaaaacaaacctgctacaagtcttttccttggaaaagactcacaatgacaggaacttttatactttgtatatggaaaacatgcacatacctacctggtattgcaaataagcgtgttagtaaaaggtaaatgttacattcctttttattcctaaaattgacttttgtcttaagggaaatgttaatgtgtaacacaccctttgaagccaaaataaaaacttttcgatcaggtgtaataattgggaaaaacactccagactgaacaaaactgaattacacatacacagatattagttagtaaggtgagca

SEQ ID NO: 45684 - DNA, 251 bp, Homo sapiens
tgtaattgcgcccgatcactcgcacagcgagcgctgattgcggctcagagatggcttagcttccaggctgatgggctggagcccttggaggcctaatgagggtaattgaggatgggctgattgtgccggaaaaaagctgaaggggactgagccatgagaacaggctgcgtcacaccctaaacgggaccacatttgctaaatttgtttccgacacaatttcgtggtgattacactgatttctcttgagttac

SEQ ID NO: 45685 - DNA, 429 bp, Homo sapiens
caacatggcgaaaccccatctttactaaaaatacaaaaattagctgggcatggtggcatgcacctgtagtcccagctacttgggaggctaaggcaggagaatcacttgaacccaggaggtggaggttgcagtgagccgagatcgcgccattgcattccagcctggcaacagagcaagactccatctcaaaaaataataataaatagaaaaaaactaaatggcacactaaaatgaaaaaaacaattgtgtttacaagtaattgatcacaactagttacagattgctttgttccttctccactctcattgcttcacttgacgagcctaaaaaaaagaaacagtgagctaggatcgcaccattggggtttcaccatgttgatgaggctggtctcgcactccagcctgggcaggaagagtgaaactccatctc

SEQ ID NO: 45686 - DNA, 323 bp, Homo sapiens
  misc_feature (292)..(292): n is a, c, g, or t
ctctgccctatgcgccttggtcaaattccttctgaggaagcaggaagtgagcttgctgtagacctgtacgggttcgccactgttaacacaataaagttattctttctccctttataatttgtggaagagaatttaaaatgatgtaaatattctgttcctgatcaaactttcattcagtagttttatcatccattgaagattcctgactgaattattgctgagataaatgtgaaacatctttttaaaaaagatttcaccagcatggcacatgtatacatatgtaacctaaccnctgcaatgtgcacatgtaccctaaaacttag

SEQ ID NO: 45687 - DNA, 530 bp, Homo sapiens
tggtagagtcaaggttttgccatgttgaccaggctggtcttgacctcctgggctcaagcagtcctcctgccttggcttcccaatgtgctagaattatagatgtgaaccactgcacttagcccagtcctcattcttagtggatatttgctgactcctatttcttaccttgtattaaaatttaaaattaactttgttacttgtactctgagtgttgttatagcatatagggcaattaactcttcagccacttaaccaatctgacatcccagctttttctgtaaagtagaaataagtactctccctcacaggatttttattgttaagatcaaatgtagtgtacaacccaaagtattttgaaatagcaaggtattgtatgagtatattgttttagatactcaaggtcaccacttgtattgcctttttctttttttttattgcctttttctttcctattgttttgtcctggggatccatggaaagcacaagattatgtgtttcttagaatcaatcagagttacaagtcacaaata

SEQ ID NO: 45688 - DNA, 316 bp, Homo sapiens
ttatcttcaaggaatatagtgacttaggcaagatatgtggggggagtgtgtgttttattttgtcttaaaagtatttggaaagctgtgtatcatcatagagtcaagaactttgtgaaattgtgttggcaagcagaaatgagtaaatatggctttttttgtggtttgttattttgtctcgcatatggatacctaaactactcacatatgaatgttacttcaagaaaagaaaatacatgaattgatcatattaaaatagttaccttataagtgacattctgtaccgtctgaggtgtcagaggttggggtcatagatgag

SEQ ID NO: 45689 - DNA, 397 bp, Homo sapiens
attctcctgcctcagacctcccgagtagctgggaccataggcccgcaccaccacacctggctaatttttgtatttttattagagatggggtattgccatgggtggccaggctggtcttgaactcctaacctcaaatgatccacccacctcggcctcccaaaatgctgggattacaggagtgagccactgcgcctggcgatcacttgctttttgattcatgcaaaaacgtgaagtttaaagtaccatggcagaggggaattctgtgtgatgttgcttgaccatttcttagtcactacaacctccgtcttctgggctcaagcgattctcactgcggtgagccgagatcatgccattgcactccagcctggggaacaagagcaaaactccatctcaaaaa

SEQ ID NO: 45690 - DNA, 1420 bp, Homo sapiens
tacaaatgtttgagtttaaaaacctaaattttaatgtttaaaaccaaagtagtactaaaattctagaaaacaatagcaggaaatcagaaggatgtgttagagagtttaaaagccacgctagagtcttttgttgttgttcaggaggagaaggtactgaataaagtttttttttaaagaaaaatagaatcgtaatcagaacaaatataaagctattacactcaattgttaaagggcagagacttctgaattagagtcagaatcaaaatgtaacaaatgctgtttgcaggagacaaacctaaagcaaagtgatgaggaaagcttgacagtgatgggaaaaaattatgtaaagcaatattaatatcagacaaaatggaattttaagccaaaagcacttttagaaatgaatactcctccaactgagaaaataattaccaatcagtaactaacaatctaccatccaaataaaatataaaactgcaaaattgcaagagaaatggtcagatctgcatttgtagtggtaggatttttttcacacacttctcaatgaaactgatgaatcaaacataaaatgattgttaaaaatcaaacaattttttatctttcataaagctagcattctgtttccagtaaatatactttatattcttttccaatacatggaatatttataaaaattgtccatgttttaggccacagagaagtccgaagaaactcctgaatcttcatcacatggactacattctctgatctctcttgccttaaaattacacatcaacaataaagtcttctttaattccatacatttagaaattgaaggaaaatactttttctttttgttttgagacggagctcacctctgtcaccaggctggagtgcagtggtgccatcttagctcactgcaacctccacccaccgggttcaagaaattctcctgcctcagcctcccaagtagctgggattacaggcacctgcctccgcgcctgggtaatttttgtatttttagtagagatggggtttcaccatgttgggcaggctggtcttgaactcgtgaccttgtgatccacccgcctcggcctcccaaagtgctgggattacaggcatgagccgccgcgccaagccaggaaaatacttttataaaattcatggggttaagaggcaatacagtaaaaattacacggtagaaactgagttaccagtgcacaccaaaacttgggtagggagaatatacctaaagttgtccttagaaggaaaattgtagttctgtatatcaacatattaaagatgaaaataaaatttaaaacaatagcacaaaggaagaagaaaataataaaagcaggagaacaccttgttctatcatatatggtattctgtggtacatgatattctatggtatagaatgagatgttgcccaaatgtaggg

SEQ ID NO: 45691 - DNA, 455 bp, Homo sapiens
caaatatttatcaaaagaatgaaaaagcctcacaaaaaatatgaccacatgcagccagagatgagacagacaaccaaaactgaatgcaccttttcagcaataacaattttagagacgttcccagaactaggatgggtgtctacaggtgcttacccagtgtctctaggctccagggcaacctgtttcttagagcagagcttctcaaactttaatgtgcacacaattaacctgggatcctgataaaacatggatttggattcaatcgagctgggctggcaacaaggactctgaatatctacaagctccaggtgatgctggggcacagaacacactcaacgaggcttctacccactaccccaattcttagcaccaaacactttccccagaggcctagcctggccctccatcctcaagcatgtctgcacctgaaatcatctttgtccccagcatcttgg

SEQ ID NO: 45692 - DNA, 592 bp, Homo sapiens
ttttaagagagatagaattccatttacctgcatttatattatgaatcccagtaagcttagactagataatctataagacatctacttcttctaacttagaaaaggaatttattcagggagatattaagtagctcttagaggcaaggctgaagtttggagtgtgggcaggcaccaaagggaatccacgaggctggagctgcagccatggccggaacgtgaatgacctgattaagatgctgtcactgttaggtactggaaactgccactggcattcctggacactaggcaccaatggtggtcactagatactagagggtaccactacctgtgccagaatgaaccctgaactaatgcagcatctctttgttgcttgccccaagactcagctcttcaaagagagtatctgattggctagtcttgggtctcgtttctgtatttttgttgtcagggtactggaagagcaagtgtctctccattgggacttttataatgaaaagactcacaagatagttggtttcttaagtgtcggaaggactttcagatgctaaccaaaccgcatcccctacaaaagacaaatatcccccacaaactt

SEQ ID NO: 45693 - DNA, 468 bp, Homo sapiens
gcagggactcaaaaaggcacccatgggaagaagcaggcttaattgaacaaaatatgctaaacaactactatgtaccacacactgtactactagctactggagtggcaacaaagtcactatactcaaataactctaaaaccaataaaaagggaaatgcaaacaaataacccatatttctttaattcaacaatgcatattttcttctaatgctaacatttttgaaatctatgtatgcatttactgaagtggtgtttatttgtcagaaaagttattaaattgatggtgcatactagggtgaaggaaatatattcactgcaatacaaaatcacagcggctataatagaggtatagagtaatcactgttatgtagaagatgaggggaaagggaaaagataaaggcctgatctgggatacaaagaatcaataggagttcacaaggtggaaagccaaagaaggatattaacagga

SEQ ID NO: 45694 - DNA, 373 bp, Homo sapiens
ctggcaatctttttgttgcagttatttgtatactggaattaatgccacatactcaattggctttacaaactcaaaatctgaattactgctttgttccattgtgttctttctctgatacgccagcttttcattctttaggcctgagaggttagtggctttattttacagagaagtcaaaaactgaggcaaaaagttatgagtagaatattattaaggagatcctgtttttactatttcccagagctaaaatgttatcatagcaagatttgaatgggtaaaagctggtacagttcaattaagcactgaaagtaaatgaaaaattttgagataaaagaaacaggcaaaagattacattaaatttaagtctttcttt

SEQ ID NO: 45695 - DNA, 310 bp, Homo sapiens
ctattattcccatctttaataaattgagatgtagtgtgatcaatttagtgagcattggcagcattttgtaaatggaacagacaaaaaaccctacttaagttagattgatgatcacaataactttgtagtgaataagtgatggaaagaaatgaaactactgatagaagtaaatgaaacaaggattatatgaaactttggcttcatctctgttaaaataccttcttttttcccaatattgcagtctaccatttcaatattataaaaatatttattctggcttttcatagattccacactgtcatccataaag

SEQ ID NO: 45696 - DNA, 1803 bp, Homo sapiens
ggcagcagagagtggcctcggagggaagccactgccacctgagacagcccaagcagcaagataaacccgctccacccgacccgccgaccttcagctttgtgggactatcaggaaaaaacaaaacaaaaacaaaatgtagaaaaagcaaaagctcttttctgtcctgtcagtctcctgtctccttttgctctgtctgtgcgctggtaaagtccaggtcctcatccgtccgctgtcctcattctgcggcctcagcaaaaagccacaaggtctgagcggcccgggtcctgccgggctgaccatctccggatcctgggacactctgcctgaccatctgtgtagctggtgtgggaatctgggggcattggagggagggggttttatttattgagaaatggacttcgcctgaggctgtttgccaattcagggttctgctgggcgcaaggaacgcactgttcaaacgcactgtttactttaagcgcacggggagaaacgaataaggaggacgtggtgatttttaatttatacagtaacttttgtacttctctggtatggagagtttggagccgaatgatttgcattttttacatgtccgacattatttaataaataatttttaaaagaaaagaacgataaatgaagccaacatgattttctcatttcgggaggaactctgttgcttcgcctggacaagaaggaaaatgctgatttcctccttgggtagaaagagggagcgagggcaaatggggagtagagagaaaacaggcgagaacaagcactctaattccagtgggctttaaaataagacaaaatcagctttacaacaatccctagaggctcgaccacagaataatgccagtcaccaccctgaacgcacaatctccagtgcaggatctaatgactgtacatattattgttattattattattgttattattgttgttctgtaaacatgttgcacaagcttagcctttttgcgttctgttgtgtgtggctgtaaaaccccatgctttgtgaaatgagaatcttgacatttttcttgtgaaatttggaaaatgtgatcaattgaaatcaactgtgttttgtgttctctatgtcaaagtttagttttatattgagaatgttaacttattgctttgtatcttgggaaaaaaactttgtaaataagttataaagtttctttgagacagtaaaattatgatttcttgaaaacacaacaaaaaaaaggaacagacacaaatcacaccaaccaccacaggcaagaccaccaccaccacaaacacaaaaaaaagtgcggccacaaacactcgcgaacccacacaccaaagtagaacgccccacatagtacacacagcacggaacccgaggaaacgactgagaacctgcggataaccccaccacaaccatagttatctaggaggggagttaaaataattcctctccgcggaccgttaacagaagcatcaacaaccagcggacacctcaccacacacccaacccaacaaatacacaaacacaactactaaccagccaactaaggagcgatgagaagacagcgcatatctatacagcaaagtgtggagacgcgacccatcgcacggagatggtcggaggcaaagaggaacgaggtgcggtggagaagacagaagggcggaagagcgaaggaggcaaaggagaggacggagaggcgcacgaccggggacagtcgacgatgggcaggtagaaggacggctctatatagtctacacgtgtacacgaacgtggcgcgggtagagcagcaagtgggcagccacacgtcgcgtgcc

SEQ ID NO: 45697 - DNA, 80 bp, Homo sapiens
ttggcaaaaatccaactgcttgaaaatatactggtgggaagggggcactgtgaggaagctgggactcgtacattactggt

SEQ ID NO: 45698 - DNA, 319 bp, Homo sapiens
accatctgctccatctgcaagtaattattattctgattgctaataacatagacttttttaacctatttttgaacttttataatagaattaaacaatatatattcttttctggatggcttctcttactcagaaatgtatttgggagagtcatcaaagctctcttgggtataccatttatccttcttgcttgataatactccatgtatttatatatatgctatgatgtgtttatttcactcttgatggataactgcaaaacttccaatttaagctgttgtgaataattctttaataaacaattttgtacatttcctgaata

SEQ ID NO: 45699 - DNA, 428 bp, Homo sapiens
ggatgagttaaattttgaaagccagaattaggaggagaggataatataagtgaagaagtatgagtataaaatcaatgaggaggtttgccagaaatagagaaagggtgagtttacctattcatgctgcagcaagaatgcatgacacatacatgacagataggaggcacacagatggacttttacagtctctggggaggtacgatagtccatgagacactgacacctggtgtaatgtggcaagagtgagcctgagatgcttgtgtagagaaatagggaaacagataagaaaagaaagatgggctgggcgtggtggttcactcctgtaattccagaactttggaaggccaaggtgggcagatcacctgaggtcaggaggagttcgagaccagcctggacaacatggtgaaaccctgtctctaataaaaata

SEQ ID NO: 45700 - DNA, 639 bp, Homo sapiens
tctttgataagttatttccttcttccagctcagtattctcatctgtaaaataggaataataagtactctgtacaattcctgtgaagattaattgaatacttaattggcatgtagttgcactgagtcaaaagtatgtattctgtacaattcctatgaaaatttgttgagacacttaagtgccgtgtaattgcactgtctcaatgagttgcagtgagtcaatgagctgcttttattattttctttttaaagaaggaacaatttgaaaaatacaagtagaaaattattaactttggtaatattagagatttggtgcagaaaaagaaaaccagaaatttcaataccattaatatcagaagcccagataattacttgtaaagtgttttaatgctctcaggccaagagtttgagattagcccaggcaacatggcaagaccccatctccattaaaaaaaaaaaaaaaaaaaatcttttttcttttttttttttaattaaccaagcatggggacacacgcctgtagtcctagctacttggaatgctgagtgggaaggattgcttgagcccaggaattggaggctgcagtgaattatgatggctctactgcactctagcttgggtgacagagcaagactctgtctcta

SEQ ID NO: 45701 - DNA, 215 bp, Homo sapiens
gctgcctgcctttcctggctcatggtccccttttcccctgcaatgcccagttgaatctttcttgcattgcattactctattgctaactctcctaccttccttttcattttaaggacccttatgattacagtgggatcctccagataatccaggataactcctctcagggtcagctggttagccaccttagtgccttctgcagccccagttttccc

SEQ ID NO: 45702 - DNA, 362 bp, Homo sapiens
ataagatcgtttgtttagcctttcagcagcttagcatttttggatttaatatcaggacttgaactgttgaacagtaacccctgaaaggccacgacaggttgttagtaacttgactgaagcactaattacaactgggcctaagctgggagactgtctcctaagaactagacactcatggagtgaatggctaagtgagcctagccaaccacttaacgtttcaacctcaagttggttttattatcctctgcttaatttataaatagtaactcctgagctgctaaagactttattcctttgtgaaaaatactctagagaagaaaggcaattattagtgctattgatggaggtaaatattctgaggg

SEQ ID NO: 45703 - DNA, 223 bp, Homo sapiens
agtgagtgtgcaaaggacagagctggactactcttaggaacaaaattggcttcctggagagccgacagaagaaatctggcaacctaaaaatatttaaagagcttacgacccccaagggagaatttccagctattaaagtagaaaagattaaacatttgctgggcttgaaaaggagatttttaatggaaacactcaggaaaatacagtttagatagagaatctt

SEQ ID NO: 45704 - DNA, 1404 bp, Homo sapiens
tatgtttgattattgatgtgaatgcaactttttagaacatagctgcgtactcagtggactcagtacatactgaccagttgttgaaaaatctgatgcagcctccctaagtgtttagcatagccagagtagtttacgtattcgttaaatctgactcagtaattagcagacctagtgtttaagtactggggaaatacctgcttgcctctcacagatgtcaagaaagtacctggtagaagagtcttacgacacagcctaacttgtgtaggacagaagataccatctggactttgtagaacccagaaatacaagtctaaaaatatcttgataacaaattctttgaaatatttttgaaggtcctgagcacttcacttttttggctatattattaggaattgtttgatctctgcaatttcaacaatgattacagtaatcactgtcattatcaagcatttactatgggccagaccctttcctaggtactttacatacaatatattgttctgttaaaaacttaacaaggtttgtattattattttacaaatgaagaaactaaggccgagggaggttaactaacttgcccaggatcacacgtatggtaaaggcagaagtaaatacttgagatatggtttgttgagttctaaaacttaggtgaattttacctcctaatacgtctcaaggatgtgggtactggaggaagaactgtactgaaatccaaatatttggtgctagctgttttgtataatactagtaaatattcatattgcccttatggtattgcttatgatcatacaataattggttcttgcttatatagaaatctacagttttctgtagtgaatatatgtgttacagcaaccacaactatttatctgaaatatcagtaaatatttatcataggaatgaacatatattaagtcttgacagagctctcgaggcataatgacttggttgaaagtagcagatttcagtaagaaccatgccaaaaatattaagctataagttattagtgtacctagttttaatggcaaacatgatgattttcttagtgccatatgatgaaataaataacttactagaagtttgtagacaggtttttttttccccctctggagacagagtcatgctttgttgcccaggctggagtgcaatggcataattttggctcactgcaacctctgcctcccaggttcaagcaattctcctgcctcagcctcccacgtacctgggattaccatgcctggctaatttttgtatttttagtaaagatgaggtttcaccatgtttgcctggctggtctcgaactcctgacctcaggtgatccccccgcctgggcctcccaaagtgctgggattacaggccacctcacctaggctagatagttttattcacttggctgtttcacca

SEQ ID NO: 45705 - DNA, 1274 bp, Homo sapiens
aactatactttccatgctgtacaatagatctcaaaatgcaaaacaatagaaaacccattgaggctttccaggggcctagaagaaaatcccaaagttaatttggagctcagaaagttaatttagaatttgattttgggaagcttgtcaaaattattgaaggtttaaaacacttgatcaaaataggatcacaggtcactgcgaaatagtagtcattcatttaatcagtgtgataataaaaggatttcaaaaggcaaatacagaattgtttgatctctgcaatttcaacaatgattacagtaatcactgtcattatcaagcatttactatgggccagaccctttcctaggtactttacatacaatatattgttctgttaaaaacttaacaaggtttgtattattattttacaaatgaagaaactaaggccgagggaggttaactaacttgcccaggatcacacgtatggtaaaggcagaagtaaatacttgagatatggtttgttgagttctaaaacttaggtgaattttacctcctaatacgtctcaaggatgtgggtactggaggaagaactgtactgaaatccaaatatttggtgctagctgttttgtataatactagtaaatattcatattgcccttatggtattgcttatgatcatacaataattggttcttgcttatatagaaatctacagttttctgtagtgaatatatgtgttacagcaaccacaactatttatctgaaatatcagtaaatatttatcataggaatgaacatatattaagtcttgacagagctctcgaggcataatgacttggttgaaagtagcagatttcagtaagaaccatgccaaaaatattaagctataagttattagtgtacctagttttaatggcaaacatgatgattttcttagtgccatatgatgaaataaataacttactagaagtttgtagacaggtttttttttccccctctggagacagagtcatgctttgttgcccaggctggagtgcaatggcataattttggctcactgcaacctctgcctcccaggttcaagcaattctcctgcctcagcctcccacgtacctgggattaccatgcctggctaatttttgtatttttagtaaagatgaggtttcaccatgtttgcctggctggtctcgaactcctgacctcaggtgatccccccgcctgggcctcccaaagtgctgggattacaggccacctcacctaggctagatagttttattcacttggctgtttcacca

SEQ ID NO: 45706 - DNA, 497 bp, Homo sapiens
acagctttacatggtgaggatgggtttattgaaccctgcctactgtcacaattaactgagagcagaacctcaaattgaggaagtgagttttgataaatagattagggttctagaatgggaggagctgcctagtgcagggattcggagcagtgggcctggctgtcacaaagaacagagcatgtgcctagggatgaccaaatacagttctagagaaggaaagatagcctagatttttacttttaagtttttgggtcaatttcaatgtcatccacattggatagcagaaaatttttctgttgaagcagctgttttttaaaaaattataccacaaaatggacttttcatgggggtgtgtgctttctatgaattttaatacatgtataagttcatccctacaaaccatccccacaaacaggatacagaacaattccactactagaaaaaattccctgttccctatccttgtggacacactaagctttcataaccatggatct

SEQ ID NO: 45707 - DNA, 571 bp, Homo sapiens
atgctgtattgaatattaggtctatgaatatttaagtggaagtagtaagaaggtcattactgatttcaggaagtaaataatctaaaacaaatgaaagtagagatggccagaaggaataagtattttcctaagggtgtctcatggaaacaagtcccctaagtctggctatgtgaaaaaaaataattacgtgggcagatgtttgcaaaacatcctgattctcctcagagagttacgacgtatgttagcctggtaaaatcctgcttagaagttctgcagaaaacaaatctctctcactttgtttggcccagtgttttccacaggtattgtcctcgggatctttttcactaatgctgttagctgagctctgttgaacatagtgtctctctcaaatagcggtccccaacttttttagcaccagggactgatttcatggaagacgattttttcacagactcttggggagggatggtttcgggatgattcaagggcattgcatttactatgcactttatttctattaatataacattgtaatatataataaataaaacaactcaccataacatagaat

SEQ ID NO: 45708 - DNA, 3102 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccatgtctggtcaccagtgagcagaagatacacagtgaccccacctcacttgctccttttgtttcagaaagcccagaggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggcct

SEQ ID NO: 45709 - DNA, 2984 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccatgtctggtcaccagtgagcagaagatacacagtgaccccacctcacttgctccttttgtttcagaaagcccagaggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggcct

SEQ ID NO: 45710 - DNA, 2972 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccatgtctggtcaccagtgagcagaagatacacagtgaccccacctcacttgctccttttgtttcagaaagcccagaggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggcct

SEQ ID NO: 45711 - DNA, 1985 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagttta

SEQ ID NO: 45712 - DNA, 361 bp, Homo sapiens
tttcctctgtttcttttattttatgtcagtctgctgtaaattctgtttacttgtttaaatgattggtgtacttctgcactccaggattcctgattgtctgaaatctccatttctccccctccagactgtgagaggacttcgttctctgttgtgtcccagtacctggcacagtacctgccatagtctgtgtctgtcctttttcctgtgtcctaccttttggctcattgaatcattttcattaccaggtaccatgcagagaacaaaaatttcactttgggggagtataaatttggaccgctttttgtgaggttgtgttacgagttggatctcgaggaatctgcagtggagctcatgaaagacc

SEQ ID NO: 45713 - DNA, 2323 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggcct

SEQ ID NO: 45714 - DNA, 3023 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagctaaaagatacctacttacagataatgtggtgaaattaaaagaatttcaacaaaagaaagtggctgttgcatgtaatctttctggcactaaagaaacgtattttagaaacttgaaaaagaaactgacccagaacaagctcatcttgaagggggagttgataaccttactacatttgtgtgagtctcgggaccatgtggaactggctaaaaatgtcatttacaggtaccatgcagagaacaaaaatttcactttgggggagtataaatttggaccgctttttgtgaggttgtgttacgagttggatctcgaggaatctgcagtggagctcatgaaagaccaggtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccatgtctggtcaccagtgagcagaagatacacagtgaccccacctcacttgctccttttgtttcagaaagcccagaggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggcct

SEQ ID NO: 45715 - DNA, 3028 bp, Homo sapiens
agcgagttggtatggtccgagacagtatggctgctgcatttcggccctcgaatcgagttctcctgcaggcgctgcagattttggtgtatcctggggtgggaggctccggctctgtcagctgccgctgccctctcggagacaacacccagcaagagaagtaccattcttttctccatttacagaggaggaacaagctaaaagatacctacttacagataatgtggtgaaattaaaagaatttcaacaaaagaaagtggctgttgcatgtaatctttctggcactaaaggtaccatgcagagaacaaaaatttcactttgggggagtataaatttggaccgctttttgtgaggttgtgttacgagttggatctcgaggaatctgcagtggagctcatgaaagaccagcatttacgaggtttcttctcagactccacatcattcaatattttgatggatatgttatttatcaaaggcaaatataaaagtgctttgcaagtattgatagagatgaaaaaccaagatgtgaagttcaccaaagatacctatgttcttgcttttgcaatttgctacaaactgaatagccctgagtctttcaaaatctgtactacattaagagaagaagctctactcaaaggagaaattctctccaggagagcatcctgtttcgctgtggcattagctctgaatcagaatgagatggcaaaagctgtgtccattttttctcaaatcatgaatccagaaagcatagcctgcattaatttaaatattataatccatatccagtcaaatatgttggaaaacctgataaagactctaaaaaatgctgcagaaggaaatttatcaaaatttgtgaaaagacatgtgttctcggaggaagtgctggccaaagtgagggaaaaagtgaaggatgtgcctgcccttgtggccaaatttgatgagatctatgggacactgcacatcactggccaggtcaccactgattctttggatgctgtgctctgccacacccccagggacaggaaatctcacacgttgctattaaacaagaggatggtcagccgtcgcaccttccagccactcagccagtccctgttggctgagtaaccctggtttcagtccacctatggatctgaggggcctgcttctagtgagttattacctttcctaagaagccaggtatcgcacttcagcagacagtgtgctgacacttggtcttctcctgaaattcccaaattcactgaatggtaccatgccgatctctgagaagttatgttgcaccactgtgaaggtctagatgcaagcttggctccctcagaaaggcgcttcccttttgcatggctgaggatccttgaaggaacctggtcagtctccggttcagcttccgacaccagagtggaacccagtaagcaccatcaggaatgaatttcactacaagtgtggataactctgattttcaaaggagtagttacttgcaaattacatccttgctgaattcaggaggtatgaaaccctattttaccatgttagaaaacagcccaggattttctcattgctctgccatcatatatgtctatgacttgagcccttatttttccatctgcaaaacaataatgcctatgtgtctttgcatatagatttgaaatcttcattcaaggtttagtaggatcatattttctcaaaaataagagaaataaggttcataagcaaacttgctgggattgtggttgttttgttttctcagcagcacaaacaaaaccagaatttagcctttaggactgctgagtaagccaaatttaaatgactactgctttgttcatgggtaagccatgtgcttttcaaaataagtgccactaaaaaccacataatgctttggtttctatgtggataataaatatttagtcctatagtttatcttatttgttaatgatttttctctcttgaatgcctcatattaaaaaaaaatgtgccatgagagcagttcaaagctgcttcatacttatggtctcaaatatagtatgtgttgaattttaccatgtctggtcaccagtgagcagaagatacacagtgaccccacctcacttgctccttttgtttcagaaagcccagaggttgctcagacctcaggagctgtctgccaagattgctgcagactcttcattgccacctccaaaactaagactgttcacttggttgttgttctaaggcaaggattatagagtcagaaattgtagactaggagaagtcttctgagtctcctaattaattccttcatctttcaggttaaggaaacgatccatgcaagagaggcccaatctcaactgtagactgtgtcccagtaagagagtcacagcttcaggtgtttgctgaatccaggtctgagatcacaatcccacctgaggacaggatccgcatatgagagtcgcacattggtataattgatttgtggtagagctgagattagaatccagattcctagtctagtatccttcccactgtaccacattatctcttttcagaggggaaaaaggagcagctcttaagaaacagaatactaagggcccccattactgtgtggccctgggcatcctcagtttcctcatttggtaaatggggataatggtaccgacctcttaggcttggtgtgaggatgaaatgagatagggaatataaagcaagcagatagtggctggcacatagtacatgcaatatgtttgaaactagttaaggaattataaaaacaaatgagttcttccttctgctcaaaaatattgaatttcttgtccttgtgctctgtgaaacattgaacagccccatttagagaaacaaattctctgccctcatagaatcctaattgtttctgtatgtgtctggtgttttgcacatgcaaaaaaaaaaaaaaagtgcttggatttctccactttcagtcttagggaataatagggcatgcttcctgtccccccagcttacttttcatcttctccaactctcacagttcaaatggctccagtgctgtgggtgagtgtggcct

SEQ ID NO: 45716 - DNA, 376 bp, Homo sapiens
atgtatttgaaaaaattctcacttctgcaaggccagttttcagaacccatattgaatttgaaggctacagatgaaggacagatggtcatatctgatcttgaatatgtttttggaagaaatttttacagaagactttcattatagggattctctactgtcattaatcacttaatttaagttatcctaacctttctatgactaagccatgtaaatgattatttttcccttttcctagttttatatctttgaagaatctattcactctaccttgagtgtcttaatatttctcaaaattaatttttatatatttattcagaatatactattcacttatttggggctatgtatttagcaagaaactctttaaagttgaaat

SEQ ID NO: 45717 - DNA, 912 bp, Homo sapiens
ataggtggggtcttgctatgttgcccaggctcccgcgcttaagtgatcctcccatcttggcctcccaagtgctgggattacaggcatgagctgctgtgcctggccagaagatgaatttaaggagaaaagaagtaatgcattttagatcctggaaggctgatgtctgaaatcatttgaaaagcagcaatagaaggtggcttttgagtcttgcatcctggggcagactgtggccttctgcataactacctggctgcatgttgtagagtcctcaggctaagggcctgtcacctggagtctagaaacatgcatgtggtttggctgggacaactgtgggccaggaattaaactgaggatgtaacgaggcagcctagaggtcgagcaccctgagcaaagcctctgcttgcaggtgaggctgctgtccctcaaaggctctgcgccaagttacaagctaggtaactcggcatgggggaggggacctgcaaatcagcagttgtttcacatgcacacatcactacatccttcttggatgttggaataactatctcaagtttaacaatatattccagaaagctatttacaagaaaaaaaaaacacacacacacacacacaataaaaaaatgaaaaaagatctctgtcagggcatctatatagctttctttagtgtgatgaacaaaagcagaaaggaaatcaagctagagatatctaagaaccaagctcttctcctacacaaagcagccataagaatagagactgtagactaaagagaataaggaattaggtttatagattacccaacattatcaatatataaagaacaaagaaaacagtacattcaagtaaaagcattctgtgagacaaaatgcggctcaaacatttcagtgttagttattttttgtaaatttttatagcaaa

SEQ ID NO: 45718 - DNA, 417 bp, Homo sapiens
aagaagggataggaaaagactcccgtattttttctcaccttcaggcctttgcacaaaagctgttcctctgcctggagcactgttttcatttgatgtgtacaatcaggtgtttacgtacgggagcctttctctgtctccaccgcgcacagcgttaaccctgtctctttatgaaacgaatgctcattattgttcaggggttggcttacctgctgctcccatccagaaagccatctctccatccgacctttaagggttaaacacccatcctcagcgctcctggagcccgcaatagcaggcatcacaccatgttatacttgtcaactctgtcacctgccaccccttcgaaacttggagctccctagagcagaaagaacgtgtcttgttcacctttgtatgcacttggtggttcagtgagag

SEQ ID NO: 45719 - DNA, 312 bp, Homo sapiens
tcatgaaagatgaaatgcaagtcacatatgaaaagcactttaagctgggcacagtggttcacacctgtaattccaatgctttgggaggccaaggtgggaggatcgcttaggcccaggagtttgagaccagcctgggcaaagagcaggacccagtaagagaagtagttcatcctcactattaatcaatgacattaaattgaacacacaataacatttgtgtccactagattatctaagattaaaaataataaaaattttaatgttggtgcagtatgagaaaacagatactgtcatatatttggtgaggatgaa

SEQ ID NO: 45720 - DNA, 344 bp, Homo sapiens
agggttaatgctgttacaaaagttgatgtcttctctgttgggaaataaatgaatcttcaatgtaagatgggacatttccttgaaaagttgttgctgtcttggcaacatactgttgaacagaaagaaggaaggtggtggaaggaggcagagagtgaatacttctcatttcaactctggatccatgtaatacgagttgacttcctcgtgtttaaagtttggtttaactaatttaatgagactatactaaatccttggagagaaggtggtcttgcatttgtccaggaaccagcaatggatgagaaagcaaacctgctgggcttttgtaaactaattttcttttttta

SEQ ID NO: 45721 - DNA, 478 bp, Homo sapiens
aaaggagttattctaatgcatacttattgcttcctattaataccgtatgtagcatctctgcaattttattgcattaactggagaatgagaaagtgttagctgctgctggatattgtccggagttagagaagctgccattatattcccctcatgactcgccgctggcccctgctgtcgaagcttcgctgtggcttcactctcagggcgtgtatctgccatcactgcctgcatgctgatagcctgggacacactattgcacaccaagcgcctttgagcaggcacttgtctcacttttctcaaatgctgagttgaaggggtgtccacgcctttttcctcattgagccagtagtctcttggttacttgtatgcagtagttatcgagagtgaaatgctgacttctgctttgacagactagagtaagggacccacggaagtcatgagcaatgacccctgagaagccttccagctctggagcgct

SEQ ID NO: 45722 - DNA, 419 bp, Homo sapiens
tggctctgtatgcactgatgtctgtttgtagaaaatgggtaattgtgcatgtttgaaaaacgggcgcttgagttggtgctgaatgcctataaaccatgttagcagctaagtcttcccagggaaatacatcgatctctgctgcaagcctagaaactgactaatgtaaaatagtaaatgtcatataaagagatgtatgtcaaataataaacttttgataaaaagctacaggaaccacttctctttgaggaaaaacaaatgtccatgtaactaatacctaaaattgaatgttgatggaaccgtttaactcagaactagctgttagatgactaaagttaatgttgcatttttaaaagacatttcttgttaaggcttacaaatcataaacggatcacctctcaaataaaaatatgtttgctgta

SEQ ID NO: 45723 - DNA, 466 bp, Homo sapiens
aaggggagagctacagagtgattaccccccaaacccccacccaatagggtttagaagcttaaataccacctaaaggttacaaaaagagtgtgggctcggatcagtggcataacatgttcggggagctggagaaggggaagcctggctagcaaaggtggtcttgttatgtaaatgaagccccacaggtggcagccctcaaaagaatagatggtaaatgttttagaccttttttgttgtatgagacagagtctcgctcttattgcccaggctggattgcaatggcacgatcttggttcactgtggcctccgcctcccgggttcaagcgattctcttggcctcagcctcccaagtagctgggattacaggcatgtgccaccatgcccagctaaattttgtatttttagtggagatggggtttcaccatgttggccaggctggtttcgaactcctgacctcaggtgatct

SEQ ID NO: 45724 - DNA, 440 bp, Homo sapiens
cgaatctctccgagctccgtgaaccaataaaacaacggtccctgtttgagttgatatattaatatttactgaggatttgcaaggttggggttaaatgtcagcagattgcgggggcagtcctgtggggaataattaaacaaatctcacagcagttcagcttcctaacatctttattaatcttttttctccttccctcctgaaagagtacattgaaatattgcttttgcaaccttagagaagattcagaataagcttaataataaaatactgcgttggcgatgtgtgtacctgatggtgtcccggacccttcccttccaggtgttagtgagtgggggagactctgatgtgtgagtcctcaccaagctgttgtgattctcacctgctcttctatcgaatttatggtgaccaatttgccaaacacaataagactgttcctgtga

SEQ ID NO: 45725 - DNA, 2715 bp, Homo sapiens
  misc_feature (4)..(4): n is a, c, g, or t
  misc_feature (323)..(323): n is a, c, g, or t
  misc_feature (812)..(812): n is a, c, g, or t
  misc_feature (1335)..(1335): n is a, c, g, or t
gaangtagcaattcgagaatagagaaaaaatgaaaatgctagaaagtcacacattttcagggctgggctggcgcgaagacacattttgacagaatgagagaaatctcataggaaggaagacaaagtcagtttgtctttgcaaggttctgggccccagatgattcattctcagatgctctgggaaggactgcgtagaataagcatgggcaaacttccaggcctagtcacaagcaactctacacactttccccatctctctggttgcgaagaggagtctcaggttagaaacccaaagcgggagactcatcacatgttcacgtttntccctgcacagtggtcagtgctgtgtgtcagtcaaggccatgtctagggtcagcgctgctccaggagcctctggctttgtccttcaggtgggcagtcccttgctgtgtctcttcttcagacccttcaaccttacctctagccctggcttttagtttgggtaggagtttgtggcacatactcttttaatgacaggagatggggcaagaatgaggatgagggggagaaagaaagacatctggaagttttgtacatgaagctccccaggtgggtgaacggtggagctgaacatgagttcagaccacgtagttcagcagcgtgtcctgcattttatagatgagaggaggctttgagaggtcaagtgacttacttgttcacacagcctggcagctgaaaccccttctccctaaaggggaggaggaacagagggcttggagttgacccaagaaatgacttcgccctcctcttcctttcctccctcttcctcttgntcttattcttcccttccctctccctcttccccactggtttttctaaacctttcttttggggccgggcacagtggctcacgcctgtaatcccagcactttgggaggccgaggcgggcctgaggtcgggaggtcgagaccagcctgaccaacatggagaaaccccatctctactaaaaatacaaaattagccgggtgtggtggcacatgcctgtaatcccagccactcgggaggctgaggcaggagaatcacttgaacctgggagatggtggttgcagtgagctgagatcatgccattgcactccagcctgggcaacaagagtaaaaactccgtctcaaaaaaaaaaaaaaaaaaaaaacaaaaaaaaaacaacccagaaaaacccaaaaaacaaacaaacaaaagaaccaaaaacccctttctttcatgcctagattcattccaaaaaggtttaagacagcaacaagtgattccaggatctcagctgtgggcatccttgtgttactggatggctgtgtgttaantgttagcagctggaataagtgaagagggtctcgtcctcatactcaaagtcctttgctcatgcccaaggccagaggctactcatgctgaaacattaccatctccctccaaagtgcagggtttagtcactgagtactgggtggagcacatgactggatcccagttaatccctcccagcttaccagtaaaacctcaggattcatgctttcctgggagccaccttcggccactaagataggagcggggttcagacatggccaggcgctcctaatctcagacccaaagtgcaatttttggcagcctgcatgagaaggagggtgggaggaaaggtggctagaaccaagggtagcagcctgggggcttgagaggaaaccaggcacagcccatcctaccctgtctcacgagcagcccgtcctcctcctgactccccttaccccacacaccgagcgccattctcttgctgcctcatctattctggttaggtacttactgagcatcaggtgctaggcaagtggctggggagagacaacgtttaatgactcagtctccgcctgcacagagcctttgagtctagagggagacacagacttactgacaggctgggttgtgtaataagtgctacgggaggaaaagctgagagtgtctgagaatttatgagatgtgtgtctcatcagacttgcatcaaaaaaaaaaaaaaaaaaaccatcctggaggaaaggacctctacgtcaagtgaagggtggggtccatttggtttttataggagcaagttctttgttggctggactctagatctcccgtcctttgactttggttacaaataatatccaaaccaccgctagtctcattctcttttctctttcctgctctagccctttgctcctctcccaggctgtttctctagctccagacagttcatattcctaaatgctgatcacttctcttttccctctcaaatgctgctttctagaaatcattttcagtttttcagaaccctgtccatctcttccaatcccctggtgtctttcccttacctgggtcattctctgggcaacatggcaccctttcagtgcagacttgtttattaataactccagtgagttttattttcctcttactaaattcaaagtactcagaacattttagacttgttgagcaatccctatcagcttagggatggggtgggggaggctaacagaggtgaattaagaatgataattccaaactaattagtcatccagattaaaaaaaatagactaagatggttttttttttttaaagacatttgtgagagaattgggaaatatgaatcctaactagatagttgataataaaggattcttgttagttattaaagtgtggttaagaaggagtttttatct

SEQ ID NO: 45726 - DNA, 452 bp, Homo sapiens
cttcacttgatactttcaaagccccagcaataggcccctggtgttctgcctgtcaacccagacatcttcaacccctctgattttaaatattttatatctttttttagaggtagcaaaagatttccaagccattattttactgaactgcataacatctctaggacacagaaaaaggaaaattatagtattttctaaaaacaacaacagaaaaacaaaatgagactttaagaagttaaatcttggacaggcgcagtgactcacacctgtaatcccagcactttgggaggctgaggagggcagatcacgaggtcaggagatcaaaaccatcctggctaacatgatgaaaccctatctctactaaatatacaagaaaattagccaggcgtggtggcacgcgcctgtagtcccagctactcagaaggctgaggcaggagaatcgcttgaacctggga

SEQ ID NO: 45727 - DNA, 463 bp, Homo sapiens
cataaaataagaatattcacaaatagttcccaaattctggagaaaatcaggtaaagaggaaggtaaatgtttcacttttccccacaaaagtatactttacctaattgctatgagctataaatggctcaaaaaaaatgtggactctggcaaaacaaatatgagaagaatcaacaatgtttcaaacaaaaagtgattaaaaaatcatttcagtcctctatcagttcagtcccatgtaattaattcctgttctgtttcatgttggcttagcaatcttcattaacacatcagttttttattcgaattttggaaatttttacctagtccaatggtatcatctccatagttatctgaaacctgtattcaagaatacttgaatatggtacaaactcgtattcaaagtcctttccacgaatttctttgaagacacacattttaggatttggagggaaacaaagctcttaaa

SEQ ID NO: 45728 - DNA, 399 bp, Homo sapiens
taagataaacattggttctgtccagaaaggcaggacaactcaaagcagggaggggacttccaggtcataggtagataagagacaaatgattgccttcttttgagtttctgattagcctctccaaaggaggcaatcagatacacatttatttcagtgagcagaggagtgactttgaatagcacgggagacaggtttgtcctaagcagttcccagatcgacttttccctttagcttagtgattttggggcccatttcctttcacagctccaaatcctcttaggtaagaaattttttcttccttttaaaaaaaatctttagtaaaagtgtaacagtcagggcctaatcagagaaacagagctacaggaatatatgtattccaagtctaaattcagttcttta

SEQ ID NO: 45729 - DNA, 231 bp, Homo sapiens
ggtcttttctaatctaagatatttgattctaggagctgcactactcctaaaataatttagtgagaaggaaattaggatctaggtaaatcagatggtcattagtactagtctgctgataaatgtccactcacctctcctagtccaataacatctataagttggcaggatgttatcagactttctaaatcaattgcctattagagttcctttaatcattattttagattttta

SEQ ID NO: 45730 - DNA, 248 bp, Homo sapiens
catgagtgaggattactgccttggcttttcagctgaggaaactgaagcacacaaagattaagttttatcaagaataatacaatcaaaccagaacccaggtctcctaacttccaggttgaatgcttctgtatcgtgctactcttcttgaacacaaactgcataagaacccacccccattccaatgccctccaaaaggtgttcattgtgctccctagaagcccctgccctcaggggcttcaagcattcat

SEQ ID NO: 45731 - DNA, 382 bp, Homo sapiens
gaaattttttgggggaaagggaaaggtcttgctctgttgtgcaggctggagtgcagtggcgcagccttggctcactgtaacctccgcctcctgggtccagacaatttttgtgccttctgagtatgctgggattacaggcgcctgccaccacccctgggtaatttttgtatttttagtagagcctgcctcggcctcccaaagtgctagaattacagacattaaccaccttgcccagactttaactgcctattcttaagcaagatactttatttttgaaatttaagatcacttccgttagctaatttaaaaaaatgattcttatttaaattgtattatagagggtaagcaaccaagtaatattctcagtgtttttcaatcatcc

SEQ ID NO: 45732 - DNA, 314 bp, Homo sapiens
ttcttgcctcaaacacttattgtgaggattatgtaagtgtgtgaatgtgtgtgtccaaacctccaggtgtgtgctggccatggtgtacgtatgcagtgagtgcttttgactgatgaccacgacaccagctttccagaccatataagcctctgggatctggggatgcaggagtttcttagctgttaggaacagaatggaaaggcacagtccttctttgagtcagcagacctgggtttgggaattgcctctgtagtttaccacaggagttatagaatagttcagggtcttatgtcttcatctgtgaaataaagcac

SEQ ID NO: 45733 - DNA, 375 bp, Homo sapiens
atgtaaagcaaccgaaactcccataaacctctggtggtaatgtaaatctgtttaacgactggaattgttggaaaaaattggaattaccttgtaaatttgaagagtaacataccttaagccacagcaattttattgcttgtaatataccttaatgctaattgaatacctaatatatgccagaaattcagttagagtttcataaatgtatactcatttatacatcctaagaaagctttaccatgtatgaagcagctaaatagctggttgaatgtcatactgctagtaccaataggagggaaattccaacttaaatctgtccaacttcaaagctcaagcattaccctgcattcgctacatgtgtgaatttaattatat

SEQ ID NO: 45734 - DNA, 368 bp, Homo sapiens
aatgggacacttgtggccacaccctggtcattctgactggctgtacaaatagctctcctggctccccaggggacatgttcatcaagatttaggccacaaagtagggccgtttgttccccctcttgcccctctccccagtcagctgacgacagctccagtgttgcagcccagcaccccaggatggatgacacacctccctggtgctccattgtcagggctctctgatttgcagaaacaggtaatagtttctgtctatggtttggaatcatgaagtagggcaagacaagtttctttggagttaaatttagggcttagaatccaggggggtggctgagtaaagctgtattttaactcctactccaccctca

SEQ ID NO: 45735 - DNA, 790 bp, Homo sapiens
gcttaaggttccataaaacagaaaaagaatttcctttgtgatgccgcaggcttggccctcaggactatagtgtggcaagcagagtcactaggaccacctgggcaaagggaacctagaagcctggcatgctggcaaaaggtaaagtatttcttaccaattagactgtggcccctctgtgcaaactggttagatgaacggtaaaaatcactgtttatctcctctgtaatgctttgattaatacaaaaaagaattctgaggttggtcttaggaagctgtaataaatctggtatgctttgtgtctttctgtattctgtcacgaagaggggtaccttcggatgaaatgcgtgcccagggccgcataagcccgctgttcaagacggcccagcaaactggtcaatcatgtccttggaagcttaacctcctaataccatgtggccctgctttctcttttcacaacggcaggccaggttcagggttccattcccggcttactcagcgagtactttctggtgtcacctttaccatgtgttgattctcttccctctgtttcttatagaacacagaaatattagctgtttggcctagccaaggttgggtaataaaagatttaaaaggactttttaaaacaagcgctatagttaaaactcaggtacattaaaagtggatatttggccaggcatcgtggctcatgcttgtaatcccagtacttggggaggctgaggcaggttgatcacttgaggtcaggaattcaagacaagcctgggcaacatggcataactctatctctact

SEQ ID NO: 45736 - DNA, 413 bp, Homo sapiens
  misc_feature (16)..(16): n is a, c, g, or t
aaacagtgagtccagnacagggacagcttaaagggaagtcccccaaatggtagcggaattctaccagaggaagagagatgactcaccccaccagccttagagcatgttagcaactgggacatcagatgtggtacacagccattgtgagacaaggtggtagaccgtgagtttacataagggcctgcaggcccccttcctgttcacacatttgcattcagatgctggctgtccaggcccaagacttagttattttctgaagaaactgaatgaccctggaaaaaagacctctcatactgatgttggggtcatctaggaaaaagacttgcctccctggtgaatcacccacaagtgatgtcttccagcaagcaagactcaaccctgtccacagaattcctgattagtgctgaactgtt

SEQ ID NO: 45737 - DNA, 848 bp, Homo sapiens
tctgcacctacacaatctgcacctagatccactgcacctacacagtcatggctcattgtggcctcaacctcctgggctcaggtgatcctcccacctcagcctcccaagtagctgggacttaggcgtgcatgaccacacccagctaatttttgtgtttttttgtagagacagggtttcaccatgttgcttgggctggcttcgaactcctgagctcaagtgatcagcatgcctcagcctcccaaagtgctaggataacaggcctgagccaccacacctggcctccctctttcttttctgattccgcctagcatattgatttcctttgttttagtttttcttttagttatctttgtaatttacagttaaacctttatttcttctttatgaactctaggcagtatctcttatccccctacttttagaagataagatggagagtgtagtatcctttctcatacttccgtgtggagaaagccaagtatacgtttaggggaatacccagaggaagagagatgactcaccccaccagccttagagcatgttagcaactgggacatcagatgtggtacacagccattgtgagacaaggtggtagaccgtgagtttacataagggcctgcaggcccccttcctgttcacacatttgcattcagatgctggctgtccaggcccaagacttagttattttctgaagaaactgaatgaccctggaaaaaagacctctcatactgatgttggggtcatctaggaaaaagacttgcctccctggtgaatcacccacaagtgatgtcttccagcaagcaagactcaaccctgtccacagaattcctgattagtgctgaactgtt

SEQ ID NO: 45738 - DNA, 1152 bp, Homo sapiens
agtgagtatatggggaatggagacttcttacccacccggctgcaggcccagcaggatgctgtcaacacagtttgtcattcaaagacccgcagcaaccctgagaacaacgtgggccttatcacactggataatgactgtgaagtgctgaccacactcaccccagacactggccgtatcctgtccaagctacatactgtccaacccaagggcaagatcaccttctgcatgggcatccacgtggcccatctggctctgaagcaccgacaaggcaacaatcacaagatccgcatcattgcctttgtgggaaacccggtggaggacaatgagaagaatctggtgaaactggctaaatgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttttccgattttggctggtgaaggtggtgccatgatgggtcttggtgccagtgactttgaatttggagtagatcccagtgctgatcctgagctggccttggtccttcgtgtatttatggaagagcagcggcagcggcaggaggaggaggcccggcaggcagctgcagcttctgctgctgaggccgggattgctacgactgggactgaagactcagacgatgccctgctgaagatgaccatcagccagcaagagtttggccacactgggcttcctgacctaagcagtatgactgaggaagagaagattgtttgtgccatgcagatgtccctgcagggagcagagtttggcctggcagaatcagcagacattgatgccagctcagccatggacacatctgagccagccaaggaggaggatgattacgacgtgatgcaagaccctgagttccttcagagtgtcctagagaacctcccaggtgtggatcccaacaatgaagccattcgaaatgctgtgggctccctggcctcccaggccaccaaggacagcaagaaggacaagaaggaggaagacaagaagtgagactggagggaaagggtagctgagcctgctcaggggactgcatgggaagcacgg

SEQ ID NO: 45739 - DNA, 400 bp, Homo sapiens
ctatagtcccagctacttgggaggctgaggtaggagaatcacttgaacccaggaggcggaggttgcagcgagccgagatcgcgccactacactccagcctgggcaacagagcgagactccatctcaaaaaaaagaagtgggacacttgtctgcatgaagaagtgaagggagttggaataaaatggaaggcagaggagcctctgctgtggtgggctggaaactccactcccgccaccccatccctcccccatatttcatcagagccttttgtaaaggatggcagaaccatggagctgggagaaggagctatcacttgcctgcagtgtcagcaaagagaggccaatttttaatgctttgtgtacattattaactcacttgatccttgtaacaggtattatta

SEQ ID NO: 45740 - DNA, 463 bp, Homo sapiens
ataactgtagtcacagcttccaagggtcttttgatgaagaatagtcttgtgtaagtacgaatgttgtgcattttattcagcagcttttgtcagatgatgtttaaggattcattgtatctttgcagccgattagggacagttatctcatgtttaggttgaagacagcttggggatggggtgctgttttttctagattcacatgtttttaaaaagaatgtttactgtcaacatgggcatgtatatttgacctgcattcaaacagctgaacgttattttaatagagaataatcaggccactcctcactatgggagaataattgggaagtatgcatacagctagcattgttaagtactaatggcaatcttgcttcggtttacttctattgttgtttttaatgcttttgtcaatcctttttattcctgctgtatattgacagtaaacattgtcgacgcggccgcgaat

SEQ ID NO: 45741 - DNA, 2014 bp, Homo sapiens
ataactgtagtcacagcttccaagggtcttttgatgaagaatagtcttgtgtaagtacgaatgttgtgcattttattcagcagcttttgtcagatgatgtttaaggattcattgtatctttgcagccgattagggacagttatctcatgtttaggttgaagacagcttggggatggggtgctgttttttctagattcacatgtttttaaaaagaatgtttactgtcaacatgggcatgtatatttgacctgcattcaaacagctgaacgttattttaatagagaataatcaggccactcctcactatgggagaataattgggaagtatgcatacagctagcattgttaagtactaatggcaatcttgcttcggtttacttctattgttgtttttaatgcttttgtcaatcctttttattcctgctgtatattgaggctgttttgcatctttggcttaactacctataatgccgttttattaaaataaaatgtattatttcctggacatatgtaagacaggcagggaatacattacagacaagttaatgtgtcttcaaccctgtctttgcgaagtggaattgtgttttcctagcatgtagaatacgaaggggttgagttctctgaagtagcaaaactacaaaagattgccggcttctgagtaaaatggcatcttacctgtcccattttagtaattcttgcactatggcatatatagtcctttaaaacatataagacaccccacattcaaatactaattgtgatattaattaggttgaaccttgtaaaattgccatttcagtaggttagaaatgttgaatatcagcagtttcatatggctcactacagtgctgcccagtggaaatagaatcaaagccacatgtaatttaaaatgtttttgcccaaagtcttggaaatccaatgtgtattttacacttagaacatgccggtcagacgagttaaattttgggtgcttgatagccacatgtagtgaatggctcccatagtagacagtgcaggttctgcctgaatatcagactgcttagtagtcattgctaagttcttcgtgccactccaagccttccgtccacacagctttatttggacccaatgtgtaacctagccaccagagcccatgtgcgcactagcttttatatttcaagctgtgttttagtcctagatcaggtagctaatttctggatgaagataggtaaatgcctagaatttacatcattaaattagttggagtaaatgtgttcaaatacatggacctgatgaatcaatggccctgttgccaagtaaaacctccattgcatttaacagtggaaagaaaatctgtcatagtgcttcccacagtctgtttgagaataagaaccaaccacttctaatatttgacacactgcacatctttttagtgtctgttgattcagacaatacacagtgagaaaagacttccattttagtaaacttattaatcataatagcatctgtatatatttgatatattatgtgataatatgtaatatctatttgataaatcatagttatttaataatgatgatattacatattaaatcactgtactggcaatacataatgtacacatagcttgccgagctctatattatgatgccaggtaacccacagtgtggactccactgtatatatgaacatcacatgcataaatgttaagcacagatagcacatatggaaaaatttgaaatgagctaaggttaaagaagatgctaaagagcaggtaccaagaaatctcagaaagcggactgaagtgttaaataaagaatgtttggcttgggaagcaatctgggcttaaattgaatgcattttatttagtgactggaaatttttgaagttcaaaaattttttaaaaacagttatgttagaatagactctgtatctgaattcttgatactaatgaccttataacaagttgggtttgatcccattcacttgagccagttggttttttgtaagtgaatttctcattaaaaaaaaaaaa

SEQ ID NO: 45742 - DNA, 771 bp, Homo sapiens
ataactgtagtcacagcttccaagggtcttttgatgaagaatagtcttgtgtaagtacgaatgttgtgcattttattcagcagcttttgtcagatgatgtttaaggattcattgtatctttgcagccgattagggacagttatctcatgtttaggttgaagacagcttggggatggggtgctgttttttctagattcacatgtttttaaaaagaatgtttactgtcaacatgggcatgtatatttgacctgcattcaaacagctgaacgttattttaatagagaataatcaggccactcctcactatgggagaataattgggaagtatgcatacagctagcattgttaagtactaatggcaatcttgcttcggtttacttctattgttgtttttaatgcttttgtcaatcctttttattcctgctgtatattgaggctgttttgcatctttggcttaactacctataatgccgttttattaaaataaaatgtattatttcctggacatatgtaagacaggcagggaatacattacagacaagttaatgtgtcttcaaccctgtctttgcgaagtggaattgtgttttcctagcatgtagaatacgaaggggttgagttctctgaagtagcaaaactacaaaagattgccggcttctgagtaaaatggcatcttacctgtcccattttagtaattcttgcactatggcatatatagtcctttaaaacatataagacaccccacggccaactgggatcctcagaacgccgcgc

SEQ ID NO: 45743 - DNA, 2961 bp, Homo sapiens
  misc_feature (442)..(442): n is a, c, g, or t
  misc_feature (456)..(456): n is a, c, g, or t
  misc_feature (1068)..(1069): n is a, c, g, or t
gagctcacagacccataatcctgcatttctctaacaagttgtttatggagttgcttctccatttgcctacatcccaaaattcacccctcccggtttcttctgccccctcctgagtcccggcctgaaggagggggagggacgcgggtgcggcgcgggtgggggagggcggacccgacgcacagggccagcgccgaggcgccccctctccgccagcggttgacgcccccggattatttatccgcaaagtcccgcgcgcgcccattgggccgaggcccgagtgtcagcgcgagtcccggctcgccattggctccgcacacgtgcggccctgactcacgtgcttccggtttgaaggcaaaaagtgtgcctgggtgattttttttttaagcgagagagtttgtgcaaagatccgagctgtcagagatttgaaaaaaaaaaaaaaaanaaaaaaaaaaaaancagcccggcgctggcggagacgcgctctccctgcaaaaaaagcaaaggcgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgcctgcctccttcctccgcgcacccccacgggccgctggcaaagtggggtggggagcgaggcggtgggggcgggggccggcgcggcggccggggcggcggggcggccgagcatggaagaacagcagccggaacctaaaagtcagcgcgactcggccctcggcgnngcggcggcggcgactccgggcggcctcagcctgagcctcagtccgggcgccagcggcagcagcggcagcggcagcgatggagacagcgtgccggtgtccccgcagcctgcgcccccctcgccgcccgcggcgccttgcctgccgcccctggcccaccacccgcacctccccccacaccccccgcccccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgccaggcgctgcctcgctcctgtgcgccccggacgcgaactgtggcccacccgacggctcccagccagccgccgccggcgcgggcgcgtctaaagctgggaacccggctgcggcggcggcggcggccgcggcggcagtggcggcggcggcggcggccgcagcagccaagccctcggacaccggtggcggcggcagtggaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccgcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacga

SEQ ID NO: 45744 - DNA, 2440 bp, Homo sapiens
  misc_feature (442)..(442): n is a, c, g, or t
  misc_feature (456)..(456): n is a, c, g, or t
gagctcacagacccataatcctgcatttctctaacaagttgtttatggagttgcttctccatttgcctacatcccaaaattcacccctcccggtttcttctgccccctcctgagtcccggcctgaaggagggggagggacgcgggtgcggcgcgggtgggggagggcggacccgacgcacagggccagcgccgaggcgccccctctccgccagcggttgacgcccccggattatttatccgcaaagtcccgcgcgcgcccattgggccgaggcccgagtgtcagcgcgagtcccggctcgccattggctccgcacacgtgcggccctgactcacgtgcttccggtttgaaggcaaaaagtgtgcctgggtgattttttttttaagcgagagagtttgtgcaaagatccgagctgtcagagatttgaaaaaaaaaaaaaaaanaaaaaaaaaaaaancagcccggcgctggcggagacgcgctctccctgcaaaaaaagcaaaggcgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgcccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgccaggcgctgcctcgctcctgtgcgccccggacgcgaactgtggcccacccgacggctcccagccagccgccgccggcgcgggcgcgtctaaagctgggaacccggctgcggcggcggcggcggccgcggcggcagtggcggcggcggcggcggccgcagcagccaagccctcggacaccggtggcggcggcagtggaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccgcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacga

SEQ ID NO: 45745 - DNA, 334 bp, Homo sapiens
agcaagcccaagcctgccatctgctgtatatagataagaacatcatggtgcagtaaaagaagcctggcctttggagtcagaacagcagggtgacttggggtcagacccagagcaccccatttccttctctgtaagatgaggataataagagtaacaaccttttagggttaaggtgagttttcagcttaggaagtctgggaatattgcaaagggcttggcaggaacccatggtgaggatctagttccaagttgataggtacagaaaaccagaacatcgggccttgagtaaagagtgaagtttcacaaaccacaaagcacctgctatgtgcaggag

SEQ ID NO: 45746 - DNA, 702 bp, Homo sapiens
ataggctggctcttcccaaggggcctcttctgggctctctgtagttaaagttctgagtgccagtgaagtggcagctttgtcatcaccagcaagctctgctcctcattcggggggaaagacaggaatggaggaaaaccgcagattggaacaccagaagaagcaagagaaagcaaatcggattgtagcagaggccattgcgagagcccgtgcccgcggtgagcagaacatacctcgagtcttaaatgaggacgagttgcccagcgttcggccagaggaggaaggcgagaagaaacgcaggaagaagagtgctggggagaggctgaaagaggagaagccaaagaagagtaaaacatctggtgcctccaaaacaaagggcaagagcaagctcaacgtgagtactccttgctactgtgatgggacgtgcaagagtaagctcaagtgagtactccttgctattgggatggtacatttgagggcagagcaaacatctggtacctccaaaacaaagggcaagagcaagctcaagtgagtgctccttactactgtgatgggacgtgcaagagtaagctcaagtgagtactccttgctattgggatgggacatttgagggcagagcaaacatctggtacctccaaaacaaagggcaagagcaagctcaagtgagtgctccttgctactgtgatgggacgtgcaagagtaagc

SEQ ID NO: 45747 - DNA, 499 bp, Homo sapiens
tgtggtccttaaacaccagggaacacccggggaggggttgagactgaggtttggggaagtgacccctactgtgaaaaggcttacattaggaagagggaaaaagatgaaagagaaatttaaggagggaaaggaatagaaaagttggtcttgaatttttaagggagagacttatttattagagaggttaatattagggcacagggactactggagtatttttgaaatatcctaaaaagctatggtgactgaagagaaggaaacatcaagaaaatgaattactacattgctttcaaggtcagttagataaaaacatagtttcatttcttctaagcatttttttctctaaccccagtattcctaatttgggggtatttagagataatatttgcctctatttcatctaccaataatatatgaagactagaagggtctatgcctcatctagttttcaaacacctttcttgattctcctgcctgttatgcctgaaggagacatata

SEQ ID NO: 45748 - DNA, 572 bp, Homo sapiens
agtgttgtattgtcgacagtaactacaaggtccttagtggagcaccttgctggtatactaaattctgagttagagaatcaggaaaaattttatttctaatcacacttcaaatatgatttccaaaggctatgtaaaagttattcagattaagttgctgctgatgagggagaagagaggaaaatgttctagagaagtagtaagtattgaggagagagaaaacatgaagtcttttaaagatacacaagtgtgtacaaaaatctaatagcttcagttacctttacttgacaggaagtagtaaaaaatgaaagaaagggtaggggcaaataatgaatgactgtgttgtgttcattcagagcattggaactcatgttgaggatagcaagttcaaggacttgaagcaaagacatttttacaaagcagattttctatttgggaatatcagcatgaattcgatatgaaaaatagaaggaaggaaaccaaaatgaaaagctagaacacactttcaaagatatcacaataattctgggaatagatgctaatgaccgaaactgtggaggtggaatttgagaagg

SEQ ID NO: 45749 - DNA, 751 bp, Homo sapiens
tgctgggattacaggcgtgaaccactgtgtccagcctagaatttttaagaactatttttcctccttcccagagtcccaaaactcttcagccaattcccaaggcctccacacccccttcccaatccttcctgctttactctcaggaggctctcctccatgttctggcccagcaacccccttcagccttcctctcaaggtggtacctctctctgtaaacagtagtcttaaccttccccagcccctccaacgtgctagccatgggcaccaattcctataagccatcctgaggatctggccaaaacaaacagttaaatggatgactagtcataaaacaacatgattgtaagctatcataaaataatccaggaccctgctcccagaaaatagccagttaaaagaaagaaggagaaacctgtctgtgggtcctacccacattaattaacctgaggaagcacctccacctgcctgacagatgccatctatccatcactctcaaccccaaagacaaagtaaagcggcctccacccctttcttccagggaggtggacacacatggagaaatcccaaacctggcttggagagaaaagagaaattattcacaaagtggcatcaactatgatgaagtattatgggaagggaacaggatgtggagacagcatcagctccgccaagtgggacccactgaattaccccatcacaggggagtcctgaactagccggaagaggagggaggaaagaggaaggggattct

SEQ ID NO: 45750 - DNA, 139 bp, Homo sapiens
  misc_feature (135)..(135): n is a, c, g, or t
acctgtgcacatctgcagggcttccagctcatcggcgttgaggtgcacgtaagagtgaaggatggtccagtcctgtcggtgccacaccagggcaggcagagtccttcactcttacgtgcacctcaacgcgatgantgga

SEQ ID NO: 45751 - DNA, 472 bp, Homo sapiens
tagcaattcttaagaatgaagaaaatatgccttattactataatgtttttcaacaatacaagtgtttttctgattaaagtgtatgtgcagactatgcttcggggaaatactttgcttgaaacagcagttttccttccacatctctttctgcagccccactgatttaccatgatgaagaaaggttgagaagttctttatgcatagctacaagccttagttctaactttcttctctgaagtcttcttttgtgcttcttacacattaaagacaaggtgaatttaaggtgcctttatggtagacgatatttttagggcctgaatttaattttcaaactgaatgagtcacacagtagcatgtactgatcaacttgcatctgtgtagcaaatatttctttttaacaattagatagttactagcttatttttatcatatgagcaatgtacattcattatagaagatttagaaaatacag

SEQ ID NO: 45752 - DNA, 404 bp, Homo sapiens
cacaggacagcctggaagggtcagtctgaaggagggtgacacatggttagtagcaaggtcactctactaccagaggctcttatccaacccctccattgaaccatgggggaaactgaggcttggaggagaggcaggagttcacccaaggccacagaggtctgaagcaggaccggcctcccatctacagagctggactcccagaagccacacaggggactgcaggaagaggggagggagggcgggggctcagccccaattgcacaggaagtctgccaggctccacccgggggcctccaggcagggcaagctgcccagcccccagcctgcagggcaggcaccagaaacagctcctctcggattctgccacaatctcagcaggaagacaggaaagctgagctgggcag

SEQ ID NO: 45753 - DNA, 427 bp, Homo sapiens
agattattggcaattcaaaagttacatgaaatgaaagggcttggtaactctaaagtccttgattcatccgacaggtcattaatttactgtctaacctgtctgccttattgcaacttggtatgaaaagaaagtcatggccgggcacggtggctcacccctttaatcccaacactttgggaggccaaggcgggtggattacctgaggtcaggagttcgagaccagccgggccaacatggtgaaaccccatctctatgagatataaaaaattagctgggcatggtggcacatgcctgtaatctcagctagatggtggaaggctgaggcaggagaattgcttgaacccgggaagcggaggttgcagtgagccgagattgcgccattgcactccagcttgggcaacaaaagaaaaattccatctcaaaaaaa

SEQ ID NO: 45754 - DNA, 377 bp, Homo sapiens
aatttatcaacgtataaaaataattgttgacataatgtgaaaaataaatattaacaataaattggaaccaaaatccccacagagacaagtgcaaggaggagtgatggtatactagggttcttgttatgtctgagaagagaattgatcgatggcaaaaattagtttaaatattgtttaaattattaaagataaccactaaaataatagaaatgtgatgtattataacttctaaacagctaaaggtaggaagaaagggagtaattaaaacctgatcagagctgcgtgtggtggcttatacctgttatcccagctctttggaaggccaaggtgggaggatccctcgaggccaggagttcaagaccagcctggccagcata

SEQ ID NO: 45755 - DNA, 374 bp, Homo sapiens
ccttttgacattttaggtgacagtctttccgtgcctattagagatggtccctgagcaagcctctggtgggtctatccaagttgatcatcagctacagatgttaagaacatgagacatccatgattccgtactgcatggggctatgacattctatctggtttttaaagtacaacaatgatcttgtacctagctttataacaagtgaataacttgctaaccattatgcatctgaaacatagccttgaaacatattaagggaaaactgatacaactaaaagcaaatactgataatctaccaatacaatgagagctctaaagcagctctctcagaaaatgacaggtcaagtcgaaaagttaaggatgttgatgatttg

SEQ ID NO: 45756 - DNA, 684 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtaagtcacggaggggctacaattcctcgcagcagggccccaccttttatttctgggagcgacctcgttctggtgaggctatttgtc

SEQ ID NO: 45757 - DNA, 2521 bp, Homo sapiens
agcggagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45758 - DNA, 2107 bp, Homo sapiens
agcggagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggatt

SEQ ID NO: 45759 - DNA, 375 bp, Homo sapiens
tagttgattcttagtttacaataccaggtaattctgtagtgaaacaaattgtaggaactttttctaggctgagttaaatatcataaaatgttatcatacctgttgaatgtatgtcatttttttcccagtgataagtagtttaatgatttgtatgtcatatatggactgtgctaagaatcaacttttctctttcaataacaagcctttgtattcatttgaagataatgcagactatgtttatgatgttatgtggtcacctacccacccagccctgtttgcctgtgtggatggcatggggagattggatttgtggaatctcaataatgacacagaggtgagcaggaaaatcctttttttccgtgtgggtctgtgttg

SEQ ID NO: 45760 - DNA, 2513 bp, Homo sapiens
tgccggttgcttctactggggttggtgcaaaataggcgtacagccgtttgcctctactcggggttgatgtaaaatgaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45761 - DNA, 2449 bp, Homo sapiens
tcgaagggcggcttggcagttcctgctgacatccccgcccggcccagctttggggaggaaaggcggggagacctgggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45762 - DNA, 2581 bp, Homo sapiens
agcggagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45763 - DNA, 2188 bp, Homo sapiens
  misc_feature (32)..(32): n is a, c, g, or t
  misc_feature (49)..(49): n is a, c, g, or t
tgaggcggtaccgtaatcgtacattcatcatngcgaggaacagcaatcngtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45764 - DNA, 2471 bp, Homo sapiens
accattttatagcctagcttgttatccataaataattaacttgggttgtctgactttagttgttctaaagcagatctattattatacaatattagtttcccataatctgcaaataatgtcttttaactattctgggttgtatgcttgcatctttaaccataggaagcctattgcatgcactagatgattgagtgacctggtggatttcttgttttgttttcgatttttttttttaatactaaccagaacatgtgttttttaattgtgaatagtactttagctttagctattcatagaatgtatttgcttgactaacttatggccttttttgctaatgcttcatggttgtcctacaaccatttaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45765 - DNA, 1888 bp, Homo sapiens
tggcacgaggtggcacgaggctttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45766 - DNA, 2186 bp, Homo sapiens
  misc_feature (1)..(2): n is a, c, g, or t
  misc_feature (4)..(4): n is a, c, g, or t
  misc_feature (8)..(8): n is a, c, g, or t
nnanttcntaaattatttttgaaacgtcataagctgagcaacctctccgtgtagtaacagcggatacctgtctatttcactatttagttccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45767 - DNA, 1729 bp, Homo sapiens
tgacaatctagcacctgcatgtatctctccttctctgtcttacctatctctcccacgatagtcaaagaagatatttatccggtcagagagagctcgtccaacaattctcgtagaatggtcaaggcatcgggtggttagttgtttggattggtcatcttatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45768 - DNA, 3308 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaacttaaaaaaaaaaaaaaaaaaaaaaaaaaaaaaaaaaaaaaaaaaatttgtgggccgcttggccgaaaaatttttaaaacctctcggttgggggagcggggcccccaaggaaggcgacaacgagagaaccttgggccaaaagagaggggtccccaaagagagaacccgggggccaagcagacatagggggtggggtttcccaaccataataaaaaaccgcccgggggggaccaccgacgagtcttagacaatctccgaggaaggccaggaggcaataggggatctaaccaaaggggccaaggacgcgccgattcaattacgcccgccgggggacaacagca

SEQ ID NO: 45769 - DNA, 3395 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaacttttcaaattttcatttttactccttacaacttgaatttttccatcttttataaaatatattttttccatatctttctttaagctcctgctgtgagcagccatctcaaatcctatagagctgtgtaccctaaatataccatgtggtatatactatagatctcccagtgcattatgaattgatgtctagataatctgttggtgaaaaaatttcccctaggttaacttttgctttactactttatattctttccatctaagacatatttcctttaaaggataaatagaaagctgcctataattttcactgattaagaactatgtatgtgacctcactgagagtaaaatctttgagagaaattgatttcatgatttcagtagccataaaggcaaagtgctcaaatggacccatactttggcattaaaatc

SEQ ID NO: 45770 - DNA, 1331 bp, Homo sapiens
  misc_feature (6)..(6): n is a, c, g, or t
gtattntgtgttccaacaacatttacacaatacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45771 - DNA, 2119 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcaaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcatattgcttttccccccaatgatgattggt

SEQ ID NO: 45772 - DNA, 670 bp, Homo sapiens
cagggtcttttcccctcaaaggcctacttcacagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45773 - DNA, 1341 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagttccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagtttcccccttattagcttgctggggaaaaaaaatccccaattttttcacttttggggaaattttaaaaattttttttcccaatcttcaaaa

SEQ ID NO: 45774 - DNA, 551 bp, Homo sapiens
tgccggttgcttctactggggttggtgcaaaataggcgtacagccgtttgcctctactcggggttgatgtaaaatgaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcaaaaaaaaaaaaaaaaaaaaaaaaaaaaaaaaaaaaaaaaaaaatttgtgggccgcttggccgaaaaatttttaaaacctctcggttgggggagcggggcccccaaggaaggcgacaacgagagaaccttgggccaaaagagaggggtccccaaagagagaacccgggggccaagcagacatagggggtggggtttcccaaccataataaaaaaccgcccgggggggaccaccgacgagtcttagacaatctccgaggaaggccaggaggcaataggggatctaaccaaaggggccaaggacgcgccgattcaattacgcccgccgggggacaacagca

SEQ ID NO: 45775 - DNA, 2970 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45776 - DNA, 2422 bp, Homo sapiens
agttttaagaacgtgaacatgtcggtcatggaggaaggctctggcttctgtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45777 - DNA, 3051 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgtctatttcactatttagttccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45778 - DNA, 2582 bp, Homo sapiens
ctcagaggatcccctgtatagcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagttccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45779 - DNA, 1822 bp, Homo sapiens
tcgagctcggtccctttgtctgacccacctgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45780 - DNA, 1534 bp, Homo sapiens
gtttccgtagtgtagtggttatcacgttcgcctcacatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactt

SEQ ID NO: 45781 - DNA, 2157 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttggacttgggccgtagtttttgggccaaacgaattaccaggcccttttggatttcattttgcaaggaatatggcagccttatggttaaggatggtaatgggggggtcacctttccccccccccg

SEQ ID NO: 45782 - DNA, 1749 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacatctctactgggcgggaactctaggtcgccccg

SEQ ID NO: 45783 - DNA, 1321 bp, Homo sapiens
cagttgacatatttttatttagattttgcctaagatgccacatgaagcctatataagacattctttccctaaaacttacatatgtatgtacatatatatatataatgttttacatcctaaacagtctacttcacgtcttcaccaaatgtgcagcagcgtgattcacaggttcaccactggaaaatagaccttaaaattccgccaatattgggtcaaagatcttacactataacacatactacactgtgggcacggatcaacagacgagaatactttatacagaagcttctcgacggaagaaggccttggagtgggaaatctaaaggaggggacacactacatgtccccagcacaccttgcgacgcccagcgaccacaattcccaggaacgcactgctcgtcgcacggcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttttgtcactcatcgtttgactagcagtaaagctttgacacataatacaagcttagtattcata

SEQ ID NO: 45784 - DNA, 736 bp, Homo sapiens
ccagtggcttccagtgggaatcagaacaggtcaggcagtctcctctttgccactaaatgctttgcccaaagaaagaccagatttcatttggctttgggatcaaagctggggctggagggtggaggtgtcaagccaggccaggcaaagggagatttgaagccagagcaggtgggcgcatctcccaggaaaccctgcatcattctttcctggtgattctttccttctttgttatggttcacatgagtctatggagtgctcattctacattctccgttcttatcttcatcctatgcaactttagaccgctactgttttttaaaagtgatttgatttgggctgtaacctttttttattgttgttagctttgactttgaaatgtgtaataaagattcaagtgagcattagaagttttttttaaaagtagtggtttaaaaaaaaaaaaaagaaaaaagtgatttaatagctggtcttcttttttccttaaatcgtcactttcttgtcaactgaaaaactaagtcgagttactaaaatggccgcacatttaggacttagaacagctgccctggaagttagaagaagtgcgtcaagtatagttacagcttggtctggttggcagtgagatgagtatagaacatgctgcttttgtggtgtataactctagaagggtttaggggaggtggacatggcttcccaagaaggtggaagatgggggcaggaggagatggcgtgcttcctc

SEQ ID NO: 45785 - DNA, 440 bp, Homo sapiens
caaaaatctcataagggttaaagaaagtttacgaatttgtattgggccgcatttaaagccgtcctgggctgcatgtggcctgtgggttggacaagcttgctctaatcacttgcacgtagagggctgggttccctgcccaggacatagagcacctcctcaggacctcagagctctgggaggcaggagagtgggaaactgaggtgtggacggaggcctctgtgcttggccaggaggggacgcagggaagagactttgtcactgcccgacgttcacccggcaggctactgagctgccttggggaagaccctgcctccggacaagagcttcctccaaagcaatgacactccttccccagtgccctgggctttggtccagggttgtggccccaaagaggtgccaggcaggacctaagggatggggtgactctgggtccccggcag

SEQ ID NO: 45786 - DNA, 448 bp, Homo sapiens
cctgctttttatttaaaaattgctcttctcagtattaaaatacttaaagtgcttcagcctgtgtctttttaaaaaatttttatgtttgtttttgtttttgtttgcccttgctcctaggaactcctatccccccaaacacagtgggccaaagggtgctcagatctaggccagtttgggatgtgattcgatcaagcagccattttaggacatgtactaaacattagagaaatcgttttaaaatactgccaattaattcagatttccaaagacgactggtcccattcctaacaaagttatcacctttgagtaaacaaacaaataagtgaaccatcacccctcactggtgccaattcatctttaaggagtacttttgtgactatccatgcaggctgttctgtacaatcacagcatacccaccaaatcctgaggccattacattaaaaaaaaa

SEQ ID NO: 45787 - DNA, 733 bp, Homo sapiens
  misc_feature (11)..(11): n is a, c, g, or t
cgaggatccgnccggacgcggggcttcacgctcggcctcccaaagtactgagattacaggcatgagccatcgtgccccgccagaatacttcttacatgttggctcggggctcccaaaagggcaaaagtggaagctgccaggccttcttaaagcgtaggtgcagaactagcaccttggctatattcttggttaaagcaagtagaagggctagccccaattcaaggggaggggactatgccagggtcccttccaatactggaaggcatggttcatttcagcaaccaatgtaacatattaccacagaaagttttccatctttggttggtagtggctttgatactagttatggcattttatttagtgcatgctgctggaaaggtaaaagaaaagatggcctcggagataggactggtggggttgaagtgattgtatttaagatattggtaactttctgttagctccaaagagcaacccagtttacctgtaggtcgggccagagagaccctagtagcactgcagctgggaaacctggcctttaatcctgcccccaccatttactaaccctgtgagtatgggcaatttgcttaaacacttgaaggcttagtttgctcaatattacaaaataggataataatctcatggggttgtgagaattaaatcagataatgcatataaaacagcagaatgtctagtatatagtgagttcctaataataataatattgttccttata

SEQ ID NO: 45788 - DNA, 248 bp, Homo sapiens
tttatttagtttttttcttcttgtgttttacacattctaactccccaaacaaacccatccactctttggcttcagtgttgtctgtttgcaggtgacttccagaactgtgtttctgacttctctgcgctctgcaggctcacatttttaaggtatatagcagaaataaaatgaaattaactgggcatggtggcaggcgcctgtagtcccagctagtcaggaggctgaagcaggagaattgcttgaacccg

SEQ ID NO: 45789 - DNA, 375 bp, Homo sapiens
aaaaaaatgcaaaacccactcatggctcctggggcatacaaaagcaggtgactgactggctttggcctgtggctgtagttggcagaccccgatctagagcagtggttttcaaacttgagagtgtatcccaatgccctgaaggttttataaaacaaagctggccaggccccaggcccagaggttctgattcaatagatctgggatggggctcaagaatgtgcatttctaacaagttcccaggggatgctgctgttgctgctgctgctgttagggtggggaccacacattgagaaccatctgtctagagcaggtatatcctatcttttggcttccccgagccacatgggaagaagaagaattgtcctgggccacata

SEQ ID NO: 45790 - DNA, 292 bp, Homo sapiens
ctagcgaaaacatcaaattccttgacttgttcacaacctcactttccatccagacccagcactcctgaccactcccaggctttgagcagggaaggcctcaccagctgcagaatcctactctcctcccagcgccaacccccaactcagatcacaacccctgagtgcaaggtgagcccccagcccctgtgcctatgcagttcctgacaaatgctgcgtctcaggtgcccacactggatggagcattcagggtcctgcagagccggaccacctttccacacgccccccaccccca

SEQ ID NO: 45791 - DNA, 388 bp, Homo sapiens
taatgtcagtctcctaactgacagtgagaagaattcaaaagccatcagtagataaattgggaatgccaccaggttttttaatgacccccttttaattttccctgaagtataaaaatcatttcctcaagacgttaaagaaaagcttgaaaaaataaaattactcatggttgtaccatcgttatacaggagctgtttttttgacttttatttttctgaataaacaaacaaaaccactatcacagcaacaaaatctttgtaataggactaagaattcctgaatacttcagggaacatcctgaggataaattagacttatgagtattgatagtggatgccacgtgatctgtgcctacggtcagcttacaaagagcttttaaagcagtcaggt

SEQ ID NO: 45792 - DNA, 152 bp, Homo sapiens
gagttcttctgagtactcatgcgtggcaagtgctagacagtccaggaaggtaccttctaagcttctaggtgcaaactcaaatcaagaagacctggtgtccttcctggtacgtgcttgacataagtgttaagaacaatgcttgtgaaattcct

SEQ ID NO: 45793 - DNA, 861 bp, Homo sapiens
gcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggtctatttatgactttaatttttaatgactacagtaaatattattgttatggaaattttaagatgaaagtcttagaaaagccacctgagccataatgacttatttaaagcaatagttcatcattcaagacacttaattgttctttattaaataaatacatgaattaggttagcctgattaattaaaattggatgtttaatcattagatttttttattactagcttttaaaaataataaaagtaggcatattaatgaagattttattttcagttctgagtgtgacagttgaaaaaataaccaaagcacaccctaaataattaaaaaataatgtcaatacacaaataataaaaaaacacttgccggcgtttacacgtctgactggccctgcgtacccactaatcgcttgagacatcccctttgcagttgcgtatacgaaaggccgaccgttgccttccacagtggcaactgatgcgatggcaatgagcgtatatttgtaaatcccgtaatttggcttttt

SEQ ID NO: 45794 - DNA, 659 bp, Homo sapiens
gcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaagatggagtgtcgctctgttggccaggatggagtgcagtggcatgatctcggctcactgcagcctccaccacccgagttcaagtgattctcctgcctcaccctcccgagtagttgggattgcagccatgcactaccatgcccggctaatttttgtatttttagtagagacggggtttcgctattgttgggcagactggtctcgaactcctgacctcatgatctgcctgcctcagcactttgagaggccaagacggggcggatcgcctgaggtcaggagttcaaggccagcctggccaacatggtgaagcccccatctctgctgggggtacaaaaattgactgggcgtggtggcgggcgcctgtaatcccagctactcggaaggtagaaggctgaggcaggagaa

SEQ ID NO: 45795 - DNA, 227 bp, Homo sapiens
tcccaagtagctgggactatgggctcaaaccaccgtgctggctttttattgttactttaaatttaatttattgttagtactgacacctaaacaatattaacaattttaattttttaaggccttaatatattttgaaggaatgattttcaccattgtatatttcttggtatttaaagtggtcatgtttactaggctggtgcagaagtgaatgtgttgaatgacatggg

SEQ ID NO: 45796 - DNA, 296 bp, Homo sapiens
agttggtgacgaccacttcctcgacgtggggcgggcggacgggaagcctggggtcgtggccaccgcctcgggagctctgggagcccgggtgaccgcgtaggtcagtttctcgcggctgtccacgcctggagttcgaggccggttcccgcgctgacgggttcccgccgggctgcgctcgggaggtctgtccgcgcctggttgggggtgggcgctcccgtcccgggcgtctcagaggatggtcgggtcgtggcgcggcgacgcagggctgcagccgagctcggcttcccggcggccgc

SEQ ID NO: 45797 - DNA, 820 bp, Homo sapiens
gcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgccagaaatggcaatgctgaagaagtaagacaactattagagaccatggcgaggaatgaagtgattgctgacattaattgcaaaggaagaagtaagtctaacttgggctggacacctctacatctggcatgctattttggacacagacaagtggtccaggatctgttgaaggctggtgcagaagtgaatgtgttgaatgacatgggagacacgccgcttcatcgagctgcctttacaggacgaaagatggagtgtcgctctgttggccaggatggagtgcagtggcatgatctcggctcactgcagcctccaccacccgagttcaagtgattctcctgcctcaccctcccgagtagttgggattgcagccatgcactaccatgcccggctaatttttgtatttttagtagagacggggtttcgctattgttgggcagactggtctcgaactcctgacctcatgatctgcctgcctcagcactttgagaggccaagacggggcggatcgcctgaggtcaggagttcaaggccagcctggccaacatggtgaagcccccatctctgctgggggtacaaaaattgactgggcgtggtggcgggcgcctgtaatcccagctactcggaaggtagaaggctgaggcaggagaa

SEQ ID NO: 45798 - DNA, 535 bp, Homo sapiens
tctaatgccgccactgatctgacgggagacggagctcaggtggtaatgcttgcttgcccgccactcacctcctgctgtaatggcccgttcttaacaggccataggacccctgatctagaatccccactctccacctacttcctgcccactcctttctactaatcattccagccatctcagagagggtgtctagccaggcagccatctgagaaatgggctagcctgattttcacaataggctagaactttactgcagtcaaaacacttctttcaaacagaagagcaataaattggtaattatatgtttgccagactccatctctacaaaaatacaaaataaggctgggtgcggtggcttacacctgtaatcccaaccttttgcacatttgcggcagcgacattgatttggtaaacagctgtcacactatttattatttgatgacttaggtatcctttccagcagtgtttttgtaaggtgtagttgcgttttcttttagtttcaattaactaaatttcaagtggttcccaaaaaagc

SEQ ID NO: 45799 - DNA, 510 bp, Homo sapiens
tgaggcagaatcttgctgggtcgcccaggctggagtgcagtggtgcaatcttggctcactgcaaccttcgcctcccaagttcaagccattcttcagcctcagcctccagtgtagctgggattacaggcacccgccaccatgcccggctaatttttgcctttttagtagagacggggtttcatcccagggccaagctggtctcgaattcctgacctcaagcaatccgccccgctcagcctcccaaagtgctgggattacaggcgtgagccactgcgcctggcctgagagtacttttagaaaacattattcctttacctttttcaaacttgaagcactccgaaagtcccaaccttttgcacatttgcggcagcgacattgatttggtaaacagctgtcacactatttattatttgatgacttaggtatcctttccagcagtgtttttgtaaggtgtagttgcgttttcttttagtttcaattaactaaatttcaagtggttcccaaaaaagc

SEQ ID NO: 45800 - DNA, 202 bp, Homo sapiens
aatgcctattatggttgcctgtgaccagaaaactgatgattgacaataaatagaatgaagggaaatttggggggtgatgaaaaagtcctaaaattggattgtgattcttgttgtataaatctgcaaattgattaaaaccttatgaattttactattaaaatggatgaagttaatggaatgtaaattatacttcaataaaact

SEQ ID NO: 45801 - DNA, 234 bp, Homo sapiens
tgatgggtggaatggttgacatgatacaaaatataaccaggataggatctatcaagaagcacacgtttggggaaagaaaagcaaattaaggagaaaagtaaatagatagtctatgtaatgaactttgcacaacacctgagaaactaatggttataaatggtatcatacataccattaatataatgttaatatatttatatgtagatagacaatgcattctttgttatatatttg

SEQ ID NO: 45802 - DNA, 402 bp, Homo sapiens
cgtctttgaggtttctctgccaacgataccaacacagtatttagggtgtctcttgggtcctgaaggagcaatctgcttccttcagagggtctgtggattctcttggctttcctggtatattcctgcagtagttctggagccaaagttcatgatgcgagtctctgtgagctgctgtctgtccgggtgagggctgcaatctagtcctgcctcctgtctatcattttccccccaaatctccaagaagaaactattgagatgaatgaaaacgaaaacataatgtactaaaacttacgggatgacatgaaagcattatgaagttggaaatttatggatgtaagtacatatattgaagaagagaaagatattaaatcaataacctatctgtacatgttaaggtactag

SEQ ID NO: 45803 - DNA, 559 bp, Homo sapiens
agacacagcctcgctcttgtcgcccaggctggagtgcagtggtgtgatctcagctcaatgcaacctccgcctcctggatttaagcaattctcctgcctcagcctccctagtagctgggattacaggcgcctgccaccacatccggctaatttttacatttttagtagagacagtgtttcaccatgttggccaggctggtctcgaactcctgacctcaggtgatccaccctcctcggcctcccaaagtgctgggattacaggcgtgagccacagtgccccgccatacaatagattttagaatattttcatcacctcaaaaagaatccctgtcccaacacaaagaaatgataaatatttgaagtgacagatatgctaattaccctgatttgatgattacacattgtatatatgtattgaaatatcacgctgtttaccataaaaatgtacaattattatgtgtccatgaaaaattataataaaagcaaaaatacaaagtgtacgacttgctaaaggctcagatgattgttagcatttttggcaataaagtattttgtaattt

SEQ ID NO: 45804 - DNA, 540 bp, Homo sapiens
gctcggtaccctatccggttcaatcgattcttgtgcctcagccttccaagtagctgggattacaagcgtctgccaccacacctggctaagttttgtatttttagtggagacgggcaagctatccggctaatttttacatttttagtagagacagtgtttcaccatgttggccaggctggtctcgaactcctgacctcaggtgatccaccctcctcggcctcccaaagtgctgggattacaggcgtgagccacagtgccccgccatacaatagattttagaatattttcatcacctcaaaaagaatccctgtcccaacacaaagaaatgataaatatttgaagtgacagatatgctaattaccctgatttgatgattacacattgtatatatgtattgaaatatcacgctgtttaccataaaaatgtacaattattatgtgtccatgaaaaattataataaaagcaaaaatacaaagtgtacgacttgctaaaggctcagatgattgttagcatttttggcaataaagtattttgtaattt

SEQ ID NO: 45805 - DNA, 453 bp, Homo sapiens
ctatctccaggagcaagactactctcttctctgagcggccctttccacacctctgcccccaccgaagccctccctcccctctcagaccccttccaggcctgctgagccccctgcacctctttcaggaagcctcccagagcccccgcgccgtgccctcagcaccaggggtcaggctacaaatgccccgcaaagcccagcgggactgtttcctcagccccactggtctctgccctaaagcaggcgagttctggagccaggcaggggtgaggaaggtgccagggttgtggcccctcatcgcccctctatgatctctgacacctctccgggtggcatcaggcccccatcacagcgaaggctgggtggtgggggcactgcgctcaggggggccgtcccgccctgtggcccgggggcgatttcccgcaccggagggctgcagggagggggcgtggtggc

SEQ ID NO: 45806 - DNA, 222 bp, Homo sapiens
cgtcggccaccctagacctcctgaagtgatgctggatttccagtgatcttcagggaagtaggtgttcacaagccttggagagaaagctgcagtaaccactgttacagccacggctgcctcacctcccagcctggtacctctgtaagcagctccatctatgtcccaccaacctttccctgtgtgctttcatggcgcactgaccctgtgctggactggactgtg

SEQ ID NO: 45807 - DNA, 496 bp, Homo sapiens
tctagtagtcctgtgtattagtttcttaggcctgtcataacaaataaccacaaaatatgtggcttaaaacaacaaatacagttttttttttattcacagttttggaggctagaagtctgagatcaagatgtcatctgggccacactccttttgaaggctgtagggaagaatctttccttgcctcttcctagcatctggtggtgcttggcaatccttggcattctttggcttatagtgagaccctggtctgtctcatagtgagatccagcctctgcttctatcttcacttggccttctttactgtttgtctgtgtctgtctccaaatctccttcttctttctcttaggaaaacgccagtcattggttttagggcttaggataatttcatctgcatgtccttaactgatcacatctgcaatgaacctatttccaaatatggccccattttgaggttccaggggaacatgaactttatttattattattatttgagaca

SEQ ID NO: 45808 - DNA, 796 bp, Homo sapiens
cataagaccaaatgttctcacccttggagctgcccaacttgtcaccagaagtgttctggccagagctggatgctgagaaataggaaagccacggaaaatatttttgcacgaactggagagtaaactaaaaaagttcatgtaacattttctactttatgacacactcagaaaatgctaattttggatggcatacatagacaaactgactctccaaaggggatgttcatgaccaaagtgactggccagacagtctagacaggccaggttctaccttactgccttgaaactgaggaatcaatatctctgcacacatagagctcatttgtggagcaccaggatgctatagcacatttgtttgtaatctctgaactaggtgactacaaaggggaccttccccattaaaatcctacaattaaatggcaagaagtgcctcagagagagacagccatgataaagtgggaatccctggctatagtagagatactaaagccagccttttcaaccagtgggcaactgtgacaccaagccaagtaactcaacagttctcattaatcacagattggccttgaggtgctccaaaatccttattcaaattccagaagcacattgagatttataaatgtttgatgtacatggtgagccaagagtaaatattgggtaataactgatttagtattgcttagttcttatcctgggtatgcctcaaccgtaacatatcacattgaccaataaatgcttttgcttatccatcttatatactaaactctgaattttttaaagtaaaaactttgtctta

SEQ ID NO: 45809 - DNA, 1701 bp, Homo sapiens
cttctttagcctgaacgatgtgggtagtgatgtggtgtgtttcctaacacctccggcagtgagccaggctttgagtggctgcgtctaaacacttctttccctgaggactggaagacattagaataagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggtccagaaatgtccttggtgtgtctgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 45810 - DNA, 453 bp, Homo sapiens
cccatgcttgtctcaaactactaggctcaaaagatccttccgcctcagccccacaaagtgctgggattacaggcatgagccaccatgcccagccctgttcttcctccttccagtttataaatggcagctctctaaatgtgtctcatctttggaatgcatcaagtagccttgtgagagctcaggactaagttccctttttatttcctatagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcagtaagtaggattacttcagagaagggtgtgttt

SEQ ID NO: 45811 - DNA, 925 bp, Homo sapiens
caagtctgagagtcaaaatagaaagccctccagcccatgtgtatctccttttcagattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaaggtgagagtggcaaagcaaaccagcaagaagatacagagcttctcattcatttctgtgctttcctgtggttcattttccaagcttagacattttcaagcccattgcaaatgttcaatagctttcatcccctatctttgtctctgtgctttcctttattcccaaggtaattctcacttcacagataatccccatctttcccattatagctctgactacatctagaatttatactagtggatggtcagaatgttcctttatgtctctttgtgtctctgtctgtctgcctcgggagcagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 45812 - DNA, 735 bp, Homo sapiens
catggtgttaaggaagtttgaacattttaacaaatgagttccacacttccatggcccttacaggtacttcaagcaggcataattgtctgcttaaggtcatctcttcaaccctgaaatcatcagctgaggacttgtgggagacattacagataggtttgggattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 45813 - DNA, 1481 bp, Homo sapiens
cttctttagcctgaacgatgtgggtagtgatgtggtgtgtttcctaacacctccggcagtgagccaggctttgagtggctgcgtctaaacacttctttccctgaggactggaagacattagaataaggtccagaaatgtccttggtgtgtctgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 45814 - DNA, 1996 bp, Homo sapiens
cttctttagcctgaacgatgtgggtagtgatgtggtgtgtttcctaacacctccggcagtgagccaggctttgagtggctgcgtctaaacacttctttccctgaggactggaagacattagaataagctccagacaattcaaacattgagattcctgggaactaccagatagtagcatcagttcaccaagaaatgaagctggtgaggcagtgaaaatccagggcctagaaagctgggaatgccatgacgtgggcacattgaaagacaagaggcaggcatgatcagccttgaactttaggaagatcccaggaagctgatggaagacaagatgtggagtgaatgtgaaggtccagaaatgtccttggtgtgtctgacagactttcaggcccatgcgcgagagcagctgtctaagtcaactcgggattttattgaaggtggagcagatgacagcatcacgcgggatgacaacattgcagcatttaaaagaattcgcctccgtccgcggtacctgagagatgtgtctgaggtggacaccagaaccacaatccaaggggaggagatcagtgcccctatttgtatcgcacccacagggttccactgccttgtctggcctgatggggaaatgagcacagcaagagctgcccaagcggctggtatctgctacatcaccagcacatttgccagctgtagccttgaagacattgtcattgcagctcccgaaggcctccgatggttccaactctatgtgcatccagacctgcagctgaacaaacagttgatccagagggtagaatccctaggtttcaaagctttggtaataactttggatacacctgtatgtggcaacaggcgacatgacattcgaaaccagttgaggaggaacttaacactaacagatcttcaatcacctaaaaagggaaatgcaataccttatttccagatgactcctatcagcacttctctctgctggaatgatctctcctggtttcagagcataactcgattgcccatcatcctgaaagggattttgacaaaagaggatgcagagttagctgtgaagcacaatgtccagggtatcattgtttccaaccatggtgggaggcagcttgatgaggttcttgcttcaattgatgctttgacagaagtggtggctgctgtaaaggggaaaattgaagtctacctggatggcggggtccgaactggcaatgatgtgctgaaggctctggcccttggagctaagtgcatttttcttgggagaccaatcctatggggccttgcctgcaaggtgagagtggcaaagcaaaccagcaagaagatacagagcttctcattcatttctgtgctttcctgtggttcattttccaagcttagacattttcaagcccattgcaaatgttcaatagctttcatcccctatctttgtctctgtgctttcctttattcccaaggtaattctcacttcacagataatccccatctttcccattatagctctgactacatctagaatttatactagtggatggtcagaatgttcctttatgtctctttgtgtctctgtctgtctgcctcgggagcagggtgaacatggtgttaaggaagttttgaacattttaacaaatgagttccacacttccatggcccttacaggctgccggtcggtcgctgagatcaatcgaaacttggtccagttttccaggctgtaagaaaaaagggccaataaccagactgctgaggttgcccacaggaggatcacaaactcacagcacagtgtgtgatgctgtccttcctggaccccattctgtccggaggctcatggcccatatttcccacatttctaataccaccacccctgtgcttcaggccctccaaacccctgtgttccccaaatgttccatgcccttctttgtatcactgactattatatgttgctctcttgcctaaatcttcctctgaagtaaaagatctcaaaaggacagatcattaatgactggaa

SEQ ID NO: 45815 - DNA, 711 bp, Homo sapiens
tccaaagggtttcctttttccccatttgatctaggtcctcctctttttcaagaccaaggtcaaataccctttccttgtctcaattctctgtagcttctcactctgattttccttaacaccttttccaaatactgggcacctcatgagttccctctacaatccatgcttcacacattgcatccaatcatctgccttaagtgaaaatctaatggtgttccctctgatgtttagaattctcttcatccttctttctctagcctcatctctcactattcctcaacagtactccatgattcagccatactgaaggacttgcagtttccctggacatatcaaactctcttttgcctctgggctcttgtataagttgtgctttccatacaaaatactctttctatgcccctcctgtccctctttttatcaggctaactctaacttgtttttcttgtttaagcttatataatcagctcttcctccactgcctctccaacaaccttggggtgggaaaccctgtgtatagcacttttcatattaaaattccctcattggcttaacttggtttaactttgaattctttgaggggagacatcggtcctatttatcccattatcagtgcctatcccagtgtctccaaccacatagcagacattcgacaataagtatctgttgaattgaattacttacctattttatttatgtgcctcatttccc

SEQ ID NO: 45816 - DNA, 765 bp, Homo sapiens
tccaaagggtttcctttttccccatttgatctaggtcctcctctttttcaagaccaaggtcaaataccctttccttgtctcaattctctgtagcttctcactctgattttccttaacaccttttccaaatactgggcacctcatgagttccctctacaatccatgcttcacacattgcatccaatcatctgccttaagtgaaaatctaatggtgttccctctgatgtttagaattcctcaatggctcccaactaccccccaggataaagcccagaggtccttcatgattttcttcatccttctttctctagcctcatctctcactattcctcaacagtactccatgattcagccatactgaaggacttgcagtttccctggacatatcaaactctcttttgcctctgggctcttgtataagttgtgctttccatacaaaatactctttctatgcccctcctgtccctctttttatcaggctaactctaacttgtttttcttgtttaagcttatataatcagctcttcctccactgcctctccaacaaccttggggtgggaaaccctgtgtatagcacttttcatattaaaattccctcattggcttaacttggtttaactttgaattctttgaggggagacatcggtcctatttatcccattatcagtgcctatcccagtgtctccaaccacatagcagacattcgacaataagtatctgttgaattgaattacttacctattttatttatgtgcctcatttccc

SEQ ID NO: 45817 - DNA, 1529 bp, Homo sapiens
gccattctaaaaggtgtgtagtggtgtctcacttgttttgtgtttttctctgctcagacagctcatccacatcacatttattttaatttgcatttccctgataatatgtgatatggaacatctatttactcattattttttcttcttatgattgaagttataatatttctttaaatattttggataaatcttttgtcagatatatgcactggaaatatttttatgggggaccagtgttaagattagatctgtttaaagagaaaggagagaaagtttcaggcagggaatgcaatcgatgtgaaggtttggggtaatttgtttcatttatctttaacaccatgttatggatggcaaaataacttcactggctttttttatcaagaaaagacttaccttttctgaatgcaacagtattagtaaacctaatggtgacaataaaagcgattctgaataaatgaaaaccaatagattgttctagttttactcataaatataattcttcatatactgagttcagttttttagccataaatgaagacatgggaaaaccataacatgttatttgctgagaagttctggcaaatgaagcaataaaataatcaaaactaaatcaacatttaaatacagaacataaagagataaatccaaaaccagaagatctctttgaaagaaaaacctaagtaattaaaaaactgaaagcacagatattcattatttcacaaataaacgttaatgctttttagacatctttaagcaactttagattgctaaaactaaaaaatgcaattaagacaataatcttatatatagacaataattgtcttaataataatcagcatcaaagattcttagaaatgttgggagactgtgtggcaaagaaagtacttcaattaccagttaccaacacacaacaatttgaaatatccaggaagatcaacccatagaacaaagaaagctaataaattaccttttcttgcaattggtttgatgtaccattaatatatagatattactaatatggcaattagtttatatgctatttgaatatgatagtaatatgaaggaagattctcttttttccacttcattgccaacaaacagctaactctaaacaacagtaaagtgtggaataaattactttgttaattaatgtggtttgaagctttgtaggaatccaattggatggatagcagcagtggtaagagaacattccggaataattacctaaattaaggagcttgccctagaatgtaaatcaacctactatatctttttatttgaaaaagtcttggtagaaaaagcatatcaactgaactgtacagtgtgttcagtgacttagtaaagaacataacttgtgtaaaggctaatgcaataagtttgagattgttctctttatgtaatagtttggaaaacaaacaactgtgattacatttagagatatgatgattatctagagggaaagttctgttgagcatatttgaacatttaattattgctgcaagaagccagtttggtcccagctttataaa

SEQ ID NO: 45818 - DNA, 1558 bp, Homo sapiens
catttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctact

SEQ ID NO: 45819 - DNA, 835 bp, Homo sapiens
ctgggagcaaggacccccggtgacaatatccttgattggttgcatgcatgatcgtgaatgaattcaagcacacctttccttctcttggcttgtgtctaacaggcacattgatttgatccacaacctctggggacactgacagaatcctggttccaagcaggagtgggtaactgagacagtaatctctcaacccactatacaaggctgttttgcaggagagccttatgatgaccagcatgatatataattgtgagaaatatactgaacaatttatgtgtcagacaccggtttaaatgcttttacaacgtaagcgcctccaattctcataaaacccctgctaggtaggcactatcagcctcattttacaactgagggttgcggccagagctgacaggcaccgtctagcgccgcttccaagccccgcatcgcatccaccagcctaactcgggcgctcggcctctccctctgcgcatgtgcatccccgcctcccgctccaggcgagtccttccctggactccagtcccttgtgggaaacaatccctcgcctccggaggcggcgaggagcggcgggtgagccccggagcactgggcgagggccagggggtccccgcgctgccctgaaggcgggcgggcggcggctagacctcggcggtggggagggacccctggcgcctgcggcgacggtgggacgagggcgtctctgtcagaaggggatgaggtctggcgtgggaacgcgagttccggggctcccgggggtccgtatgcgtccagtccctgcgcctggcgctcagcgaagtcctgtagcacggggtaggcaatgcgcactggcccgaag

SEQ ID NO: 45820 - DNA, 1772 bp, Homo sapiens
catttacagctgaaccacgtcttcaagaaagaagccaaaaatatttccgtgaggtttttaactacctctgaatctgtcctactctaaatactaccggagtctctttgtaggttggccagtatatgtttttagtgaaatattatttcacaaagaactatatcacgtacctttcctctgactgtttcctggcatatatgcatgaatatggccattattgaactatcacttcagtaaagaagttaaacagtacttttctgaggtttttcagctacctctgggtcattctgtaatgtaaatgttgttaataagaatggtttttacataaattatgcaaaggttaacaagcagtaacactgcactcctcaaaaagtggcggtatgtaatgaaaggcccttttgatatccttgatttttcattgtgtatctgtttgggcacggtctatgtaacactagttctgcgtattagtattttagagtatctctgcctcccttgtcctgttgtttcttttgcccccttggaacacattggtcagcagttctaagagacactgcccacatgatggccattccctacttcatccttgctgagctaaattttatatttttgtgcatccttctcccagatgacttaggtggtaagtccagattagtcaaagctaatcatggaagttccattttaatgattctgttggggtgaacttgggagcaatgagatgtttgggaagtattgtgtagtacttctgggaaagatctccttgatacaacattgtcatgacatgagaagagactctgctgggctttttcatgtctgtaacatggtattggcttatcgtttttatctctgaagggcagtagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 45821 - DNA, 3498 bp, Homo sapiens
gggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagccagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttattagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 45822 - DNA, 3824 bp, Homo sapiens
tttaaacatataaacaattttatgtttgggtcttgaattgctagcttctgtttttccttattccagagaataaccatactggtcacagattttagttttctcttccagtctttcagttaaacgttaccatgcatgatcgtgaatgaattcaagcacacctttccttctcttggcttgtgtctaacaggcacattgatttgatccacaacctctggggacactgacagaatcctggttccaagcaggagtgggtaactgagacagtaatctctcaacccactatacaaggctgttttgcaggagagccttatgatgaccagcatgatatataattgtgagaaatatactgaacaatttatgtgtcagacaccggtttaaatgcttttacaacgtaagcgcctccaattctcataaaacccctgctaggtaggcactatcagcctcattttacaactgagggttgcggccagagctgacaggcaccgtctagcgccgcttccaagccccgcatcgcatccaccagcctaactcgggcgctcggcctctccctctgcgcatgtgcatccccgcctcccgctccaggcgagtccttccctggactccagtcccttgtgggaaacaatccctcgcctccggaggcggcgaggagcggcggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagccagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttattagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 45823 - DNA, 2352 bp, Homo sapiens
tttaaacatataaacaattttatgtttgggtcttgaattgctagcttctgtttttccttattccagagaataaccatactggtcacagattttagttttctcttccagtctttcagttaaacgttaccatgcatgatcgtgaatgaattcaagcacacctttccttctcttggcttgtgtctaacaggcacattgatttgatccacaacctctggggacactgacagaatcctggttccaagcaggagtgggtaactgagacagtaatctctcaacccactatacaaggctgttttgcaggagagccttatgatgaccagcatgatatataattgtgagaaatatactgaacaatttatgtgtcagacaccggtttaaatgcttttacaacgtaagcgcctccaattctcataaaacccctgctaggtaggcactatcagcctcattttacaactgagggttgcggccagagctgacaggcaccgtctagcgccgcttccaagccccgcatcgcatccaccagcctaactcgggcgctcggcctctccctctgcgcatgtgcatccccgcctcccgctccaggcgagtccttccctggactccagtcccttgtgggaaacaatccctcgcctccggaggcggcgaggagcggcgggtgagccccggagcactgggcgagggccagggggtccccgcgctgccctgaaggcgggcgggcggcggctagacctcggcggtggggagggacccctggcgcctgcggcgacggtgggacgagggcgtctctgtcagaaggggatgaggtctggcgtgggaacgcgagttccggggctcccgggggtccgtatgcgtccagtccctgcgcctggcgctcagcgaagtcctgtagcacgggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacatggaatctgaagcttataaaagttgaatgacagcagcattaaacatatatgtgaagagtccccgatgtttgtagaccttattagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 45824 - DNA, 2480 bp, Homo sapiens
gggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagccagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatataaaactagacttagttgttaggtaatataccgacgggtatccaatatatattatgcattattataggcctattagtatataccc

SEQ ID NO: 45825 - DNA, 4064 bp, Homo sapiens
tttaaacatataaacaattttatgtttgggtcttgaattgctagcttctgtttttccttattccagagaataaccatactggtcacagattttagttttctcttccagtctttcagttaaacgttaccatgcatgatcgtgaatgaattcaagcacacctttccttctcttggcttgtgtctaacaggcacattgatttgatccacaacctctggggacactgacagaatcctggttccaagcaggagtgggtaactgagacagtaatctctcaacccactatacaaggctgttttgcaggagagccttatgatgaccagcatgatatataattgtgagaaatatactgaacaatttatgtgtcagacaccggtttaaatgcttttacaacgtaagcgcctccaattctcataaaacccctgctaggtaggcactatcagcctcattttacaactgagggttgcggccagagctgacaggcaccgtctagcgccgcttccaagccccgcatcgcatccaccagcctaactcgggcgctcggcctctccctctgcgcatgtgcatccccgcctcccgctccaggcgagtccttccctggactccagtcccttgtgggaaacaatccctcgcctccggaggcggcgaggagcggcgggtgagccccggagcactgggcgagggccagggggtccccgcgctgccctgaaggcgggcgggcggcggctagacctcggcggtggggagggacccctggcgcctgcggcgacggtgggacgagggcgtctctgtcagaaggggatgaggtctggcgtgggaacgcgagttccggggctcccgggggtccgtatgcgtccagtccctgcgcctggcgctcagcgaagtcctgtagcacgggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagccagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttattagcctgaagataacagtgcacaaggtgggaaaagccagctcagaggtgacgttgccgagctactctgctctctatacctgttctctactgggactttttataaccctcaataactgttttttatttggtcttagggctgtctgatacttagagctgaaggcattccagctgacacagaggaatatttttctaagtgttaatgttctatatggtaattagggggaagaattatttcttttcacaagttaatatagggatggctgtttgtatcagccatggttctttctggtggaaaacagaattctccaactaaaaatattttaatggcagactgattacagtggtgtgggccagaaacaagggacagtgaaacacccagagacttgtatcagcaggaagccattgccattctgagccttgaagggcaaggagggaaacagtgttaccagagcccagtaagaactgctgtcatgaaggaggggccaccttgtaagagacatcattactaccagaactgtggtgccaaattgctggtgtctctctttggagaaaccaaccagatacatctgctggagagcccaggtgggcacagagaagggtggagagagaatctgggaagagaaatggagaataagcagcacagtgttattcatttctgtaaattcctatgtagaaggctcagtgttagaaataaagttattctactagttgcaagttaagtgtttctgtttgttctgctttcctgttagcataagtaaactccctttggaactacacaggtatgtctctccttcaacatgtgtgaagcagacattatattaaattacattattcatacctccctgtggtgtttcttattgtatgtggtgtaaggtaagcagctctgtattcttccaaataaatagccagttgtccctgca

SEQ ID NO: 45826 - DNA, 2964 bp, Homo sapiens
gggggctgcgggggagagcgactgcgccaggtccgcgacaaatgaattagacacaattatccacgggagactcggttttcctctctgtaaattacggatattaggaatacttgccgcctggggttgttttgagcactttcattgtttaggtgctgtatttattgggtgtgcgttccctgggagagcccgagggagacggctcctgcaccggccccaagggcctctctgcccgtggagtgcaggagcgaaggggctggcctagctgaccaccagggcccctgctggctctgaccgccctcctatcccaagtaattatttacacgtttcgcgttcgcttatgtattatgtgtaatcatggcacagtatcctgaagccgtcggagtctgtgtgctggtgcaaggtctgggacaaatttaagaagagagagctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccagaaaggaaatggaaagttgatgacgtgttagagagcagccaggaaaatgaagatgaccatttttgggagcttctattccacaacaacaaaacagtaagtgtagaaaatggagatagaggaagcaaaactttcaatttgggcacagaccctgtttctttaagaaattatccctataaaatatgtgactcatgtgaaatgaatttgaaaaatatttcgggcttaattattagtaaaaagaactgttccagaaagaagcctgatgagtttaatgtatgtgagaaattgctccttgatattaggcatgagaaaatccctattggagagaagtcttataaatatgatcaaaaaaggaatgccattaattatcaccaggatctcagtcagccaagttttggccaatcttttgagtatagtaaaaatggacaaggcttccatgatgaggcagcattttttacaaataagagatctcagataggagagacagtctgtaaatataacgaatgtggaagaaccttcattgaaagtttaaagctgaatatatctcaaagacctcatttggaaatggagccgtatggatgcagtatttgcgggaagtccttctgcatgaatttaaggtttggacatcagagagctcttacaaaggacaatccttatgaatataatgaatatggggaaatcttctgtgacaattcagctttcattatccatcagggagcttacacaagaaagattctccgtgaatataaagtgagtgacaaaacctgggaaaagtcagctctcttaaaacatcaaatagtacacatggggggaaagtcttatgattacaatgaaaatgggagtaatttcagccagaagtcacatcttacccagcttcggagagctcacacaggagaaaaaacctttgaatgtggtgaatgtgggaaaaccttctgggagaagtcaaacctcactcaacatcagagaacacacacaggagagaagccctatgaatgtactgaatgtgggaaagccttttgccagaaaccacacctgaccaaccatcagcgaacacatacaggagaaaaaccctatgaatgtaagcaatgtggaaaaacattctgtgtgaagtcaaacctcactgaacatcagagaacacacacaggggagaagccctatgaatgtaatgcatgtgggaaatccttctgccacagatcagccctcactgtgcatcagagaacacacacaggggagaaaccgtttatatgtaatgaatgtggaaaatccttctgtgtgaagtcaaacctcattgtacatcaaagaactcacactggggagaaaccatataagtgtaatgaatgtgggaaaaccttctgtgaaaaatcagctctcactaaacatcagaggactcacacaggggagaagccgtatgagtgtaatgcatgtgggaagacctttagtcagaggtcagtgctcaccaaacatcagagaattcacacaagggtgaaagctctttcaacatcctgaatgttagaagccttcatacacttgtgaaattggttatacagtttcaaaaaaggagatcagagaaagccaaagaatgtcagaaatttgtagaaaatgacttcttgtttgaatatgtaaaagctttcaagaaaaattaaaacttttcattagaaaatttgtactgaggggaattctattcatctaagtaatatggtgaaaatatttatctggaatttatgttgtttagtgttatattccagacgtgataccaaaattttgttgcaaatataatggacaatatttatttatacccatattcacagtggaatctgaagcttataaaagttgaatgacagcagcattaaacatatatgtgaagagtccccgatgtttgtagaccttatgtgagtatgcaaatatataaatttgagtatgcttgatttgtatattggaactcaacatgatcataaggagaagatacgtacccttaattgagtaactactatggtatttgttaatattttctacactaaataccattggtgtctttataggttgacataattatatatgtgtatgtacatatgtttgtgtgtatatgtaaatatatttctacacacatacttaaatatagtgatgtgctagtataacctcatactgacttaaaagttctgattgttaaattttaaggaattttgtgagccagttattaaaagcagtcattatttaaaatatgtaaacttacagttaaaaacaaaggtaataaatactcagcactcatcacttcctaa

SEQ ID NO: 45827 - DNA, 1733 bp, Homo sapiens
  misc_feature (1630)..(1630): n is a, c, g, or t
tttaaacatataaacaattttatgtttgggtcttgaattgctagcttctgtttttccttattccagagaataaccatactggtcacagattttagttttctcttccagtctttcagttaaacgttaccatgcatgatcgtgaatgaattcaagcacacctttccttctcttggcttgtgtctaacaggcacattgatttgatccacaacctctggggacactgacagaatcctggttccaagcaggagtgggtaactgagacagtaatctctcaacccactatacaaggctgttttgcaggagagccttatgatgaccagcatgatatataattgtgagaaatatactgaacaatttatgtgtcagacaccggtttaaatgcttttacaacgtaagcgcctccaattctcataaaacccctgctaggtaggcactatcagcctcattttacaactgagggttgcggccagagctgacaggcaccgtctagcgccgcttccaagccccgcatcgcatccaccagcctaactcgggcgctcggcctctccctctgcgcatgtgcatccccgcctcccgctccaggcgagtccttccctggactccagtcccttgtgggaaacaatccctcgcctccggaggcggcgaggagcggcgggtgagccccggagcactgggcgagggccagggggtccccgcgctgccctgaaggcgggcgggcggcggctagacctcggcggtggggagggacccctggcgcctgcggcgacggtgggacgagggcgtctctgtcagaaggggatgaggtctggcgtgggaacgcgagttccggggctcccgggggtccgtatgcgtccagtccctgcgcctggcgctcagcgaagtcctgtagcacgggaacctaaattggtaataaatcaataagaaatatttacattcactcagtgaaaagtgtcatgtctgagctcagcatatatcggagccacacatggacacctctccttcctccactaagagcggaaaatgaacaaatcccaggaacaagtgtcattcaaggatgtatgtgtggacttcactcaggaagagtggtatctgctggaccctgctcagaagattctatacagagatgtgatcctggaaaattatagcaatcttgtctcagtagggtattgcattactaaaccagaagtgatctttaagatcgagcaaggagaagagccctggatattagaaaaaggattcccaagccagtgccacccaggttcaggcactggtaatactgcagcccagaatgcagtggagggaagcatttgagttcctattccggctggttcacatagtgacactgtgtgctatcttccacacgacggagtctcgctctatcgcccagactggagtgcagtggcgcgatctcggctcactgcaacctgtggctcccacgttcaagcaattctctgcctcagcctcctgagtagctgggattacaggcgcccaccagcaacctggctaatttttcgtatttttagtagagatgaggtttcaccaccttggccaggctggtcttgaactcctgacctcatgatccacccatctcggcctctcaaagtgcaggattacaaggtgtgaaccaccngacccggcccactattatatccttttaatatttctaagtgtttttgacaaatatagacttaccaataaaatctttcaacctgacacaacccacaccaagaaac

SEQ ID NO: 45828 - DNA, 275 bp, Homo sapiens
ataaacctatggaactcattactctggactgctgtataagcaaaacacacaaatagattcgataagcgtttagattcatcttaggatgaagaattattaggttggaggtacagctgtaatctgcaggggttcttggtatagagagcatttgtgatgctattaattccctgaggccacatatccagctggatggactggacacctgctcccagcctccttgcggataaagactgagaataaaataaatgagtatttctcccactttttaaatctca

SEQ ID NO: 45829 - DNA, 576 bp, Homo sapiens
cctacttctctcttgtgcaccctataatacaacctcagtttttgctcctttcccccaaaagccatgttttcccattcctctgtgtttctgaccatattggtcccttccgacactactttgtttttttagggaaatcctatttatcccaccttaacctctttttttgtttgttttgtttttgagatagcgtctcactctgttacccaggctggagtgcagtggtgcagtctctacccactgcagccttgacctcctgggctcaagccatactcccacctccacctcccaagtagctgggactacaggtgcacaccaccacacatagctaatttttatatttcttgttgagatgaggtttcacaacattgcccaggctggtctcgaactcctggtctcaagtgatcctcctgcctcggcctcccaaagtgctgggattacaggtgtgagccactgtgctcagtcttccaccttaatctttatttggtttcagtccaacaaatagttattgaggttttcccacatgctgtgtgttgaggatacaaaactcattaagacagccttttttttctcccccca

SEQ ID NO: 45830 - DNA, 384 bp, Homo sapiens
tgttaatatttaagagtagtatttgaaacaattttatggatttgtacacagagatactgctgatttgcatagatatctgcaggtataggtatatatctcattcaggtccaaaatccttggggttagatttgtttcaaaattcagagttttaccgatttcagaagggtgacagggtgtacatgccttatattatgcagcacaccccctagtgacttcttgggaagatgcttataattaaacacagttttgtgtctgcagtgaaacttgaatattcacatgaagtctgatatataaagactattaggtgccccacctcaagtctagtcaagagattaccaaccaaatggagtcagaacaggttttgctattaagtgagtttaagct

SEQ ID NO: 45831 - DNA, 334 bp, Homo sapiens
gggatggatggtgctttcaactgaatatatttaagcttccttaaaaaacttctagtcatatccttatttttctcattttattaccagggaatgaaccagcactgtcagcagttgggactcagccctgtgcatgaaagcaaaacatgcgggagtccaggtctcattttccaaaggttatgacgatcttccaccccattctttaaatgtagcaatgtagcaacaaaagggcaatgtagcaacacaagaaaatacttaaaggataacagcacataaacaatatacaaataatgtattacaatttcaactaagttaaatcgcccacagatgaggctag

SEQ ID NO: 45832 - DNA, 177 bp, Homo sapiens
gtaaaatttttaaaatgcacaataaagacatagtgaaagatttttaaaaatactcatgtaaacattatacttaacagaagttaatatctctgaattagactgaatctatttgctgtatgaataattataaatgggcttcttaactgaactaaataaatgaaaatatttttaaattag

SEQ ID NO: 45833 - DNA, 290 bp, Homo sapiens
  misc_feature (275)..(275): n is a, c, g, or t
ccagaacaactgactttttgagctgagaccttttaagaaggtgtacgtggggagatattgcaggcagagggaatcatgtgtgttaagtacacagagcaggaaagtgcttgggaacaaaagcttagaaagccaatatagttgagtgatccttaaatccttaagccaaggattctgccacttaatggctatgtgacgttgggtaggcaacttaacttctctgagccctagctatctcatctacaaggtaacgattacagtagtacctgcctcatagngggtgctttgagaat

SEQ ID NO: 45834 - DNA, 499 bp, Homo sapiens
aggtttattgacttattggttgattctctcattcattcaaacatttattgaaaatctaccatttgtaaagcactaatctagggactggggatacagtggtgatccatacgtttcctatctctatggcactggtgttttttggaggagtggaaataaacatatgtatgtgtaatataatttcagatagtagaaactgttataaagaaaactagccaggcacagtgtctcatgactgtattcccagtactttgggaggctgaggagggatgattgcttatgtcccggagttcaagaccagcctgggcaacataatgagacccactctctactaaaaataaaaataaaaagatcagccgggctagaggtgtgcacatgtagtcccagccactcgggaggctgagataagaggattacttgagcccaggagattgaggctgcagtgagccgtgcttgtgcctctgcactctagcctgggtgacagagcaagatcctgtctcaa

SEQ ID NO: 45835 - DNA, 508 bp, Homo sapiens
aagcctctgctgaggttgggggtgggcaggagaggacgagcagagcagctcgacggagccgagcatgtggtgagagtactgcttcgagagccccatcgagatgggatggggtctgcttctacaccagaggcactgtgcagtgcttcatccacaagttcctgagacaggtttgaatgtgactcacagaggaaagcaagcatctaacatggacatgaaaatgtccaagtgccaggcactattatgtgtccttagctcatttaatcctcaaaatactcccatcagtggttcctgagaaatgatgtcctcttccacagtcacagaggcactaagaggggatgcctggatgcatatgaagaaggtttaaagtggggagttaacttccaaatcagagatgtcacagggcagtgtgtgattatgaactggctgatccatgacacaggcactagtcagaatttttagctctttgccgggtgcggtggctcacacctgtaatcccagcactttggca

SEQ ID NO: 45836 - DNA, 806 bp, Homo sapiens
tggcatggggagattggatttgtggaatctcaataatgacacagaggtaccaactgccagcatttctgtggagggtaatcctgctcttaatcatgtgagatggacccattctggcagagagattgctgtgggtgattctgaaggacagattgctatatacgatgtgggagagcagattgctgttccccgcaatgatgaatgggcatggtttggctgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctatctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgtt

SEQ ID NO: 45837 - DNA, 749 bp, Homo sapiens
tggcatggggagattggatttgtggaatctcaataatgacacagaggtaccaactgccagcatttctgtggagggtaatcctgctcttaatcatgtgagatggacccattctggcagagagattgctgtgggtgattctgaaggacagattgctatatacgatgtgggagagcagattgctgttccccgcaatgatgaatgggcatggtttggctgaacacttgcagaaattaatgcaaaccgagctgatgcagaggaggaagcagctacccgaatacctgcttagttcctgaaaaggggagtgtaactagtggatttgggaaaggttctatacagtatgataccacatagacgaaagatgcgatgttaagtactataacagcgtagcattgattatgcgagtttgtgtcgattgttgttaatatagtgtgagtggaggttctacgagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgtt

SEQ ID NO: 45838 - DNA, 783 bp, Homo sapiens
aattacccaaagttgagtggctaagaacaacattcgtttagttcaccaatctgtggcttgggaaaaccttggctggggcagcttgcccagatatctacattggaactcctaggctctctttgtggcctaagcttcctcacagcatgggggctggggtccatgggtgagcagtctgcggtagagagcctcttctaacttaatgttggaagccacatggttatcacttttaacactttctgttcattagaagcaagtcactaagtttcacccatagtctgtatataggatgaatgattttgcttttatttttattgatgtattttttttttggacatggtgtcttattatgttacccaggccggccttgacctccatggctcaagaattcttcctgcctctgccttccaagtagctgagaccacaggaatgtgacaccacacctggcttcttttgattttttgtggacctgtataattgtacatatttatggtatacacagtaatattttgatatgtgtaaacaatgtataatggtcaaatcaggctaattaatatattccatcacctcaaacatttaccatttgtgttgtgaactttcaaaatcctctcctctagctttttaaatattagctagccaaaccaggtgtagtggcacacacctgtgatcccagctgtttgggaggctgaggcaggagaatggcttgaacccccgaggcagagattgcagtgagctgagattgcaccactgcacgccaagcctgggtgacagagcaagactccgtct

SEQ ID NO: 45839 - DNA, 408 bp, Homo sapiens
tagggtcagggttctcgctctgtcacccaggctggagtgctcactgtgacctcgaactcttgggctcaagtgattcctcctgcctcagccttctgagtacctgagacaacaggtgtgcaccaccatgtccagctaatttttaaaatgttttctagagatgaagtctcactgtattgcctaggctggtctcgaactcctgggctcaagtgatcctcctacctcagcctcccaaagtgctgggattacaggggtgagccaccgcacccagtgcgacttggttctcaactctacctatggtaggtgaggtactcacctctcaccacctctgtttccccactgtaaaatgggaataatagtatctacttcttttgtaagagttaaatgaattaatacatataaagtacaaaa

SEQ ID NO: 45840 - DNA, 389 bp, Homo sapiens
tgtgacccattgccacctttgaggtcattcagcacccgctgtgggagaaccaagaaggaatttgtctttcaaaaggttatgtgggagttttaaattctctttatgtgagagttctgcaactcctgtttttacttaatgcattgtttttttaagccattccgcagggtccagacttgcgtatatcctcggggaagcaagggtaggcctggtgtgggcaacagactgcatgccccaacccagccaaaacgctctgtgttgctacagatctatcaacactgagacacatagatatttatctactggaactcagataagagattgtcaaatgggattctgatgtttttcttaataaagatgtgaacaccatgcctctgatggagcccaaagaa

SEQ ID NO: 45841 - DNA, 288 bp, Homo sapiens
catagccaccatgtaagttcatgtcaatctgactctacatttgtgttctttccactataccatgtgacataactgaagtgcaagatccttagtgggaccacagatcagaagtggctcaatcataatcagcacacccaggaggtttattctcatgacatgggatgtaaaatagcactctccactagaagtcaaacaggaaataagcagaggagacgaagattaggtgtctgaaaagtcagctttgtttctcctacaaagcacataaagcaatgtacagtgaagggaggg

SEQ ID NO: 45842 - DNA, 436 bp, Homo sapiens
  misc_feature (367)..(367): n is a, c, g, or t
  misc_feature (407)..(407): n is a, c, g, or t
cggtctccctgggcctgatctgggttcagaaggacggagttcccgccaggacccacttacggagcgctgcctgccgcacctggggacgtcccggcgcacgtccagagtgcaggctttgcgctgtggctttcactctgcagcgtgggcccgggcgactcgggaaacccgcctgggcttcagcgcctccgatgtaggatgggaaaatgatgcagacctacctgcgaggctgctttaagacatgaatcagatgtgaagagcgactagttgagagcctgacgggcagcactgcgcgagtcttggtcatttcatcttttccgcaagttttttttttttttccagacgttgtttcactcttgtcacccagggntggagtgcaatggcgccattttcgggttcactgcaacctntgcctcccgggtttcaagtgattctcctg

SEQ ID NO: 45843 - DNA, 461 bp, Homo sapiens
  misc_feature (453)..(461): n is a, c, g, or t
ggaaaagtacctggaagaaagatgtaattaggaagaagtaaacaatgaagtagaacggggaaggatgcaaaatggagaactgtaacaatagccaggggctgggagtagagcaacatattttactacgatgaagaggaaaataatttcttccccccgtcaagcctacagtcaaggggagagacaagaaggattgtgggagaaagccagtcacatacaacagctagatcaggttttggggaagctatcgcttagcaacctttattttagactgttacatgagtacagctcgaaaaagtcaagacactgttttataccatccttagaaggatgatttgaagtatttggtaggtggtaaaataaatgtacaataatcacaaaacttttctgagaggctttattacatgttataatgttgatcttcagaaatgtttaataaaatcacatttccaggannnnnnnnn

SEQ ID NO: 45844 - DNA, 354 bp, Homo sapiens
aaagtgctgggattacagccatgagccaccacccctggccctttttttcttctttttttaaagagatggggtctccctatgttgcccagcctggtcttgaattcctgggcttaagtgatcctcctgccttggactcccaaatagctaggattacaggtgtgaactactgtgcctggctggaggttttctaaattgctctggtcaccctactccacagtgaaagaggccaagtgttagacagtggtgccatttgtttatggccacacagccagtgagtgatagagctgaattccaggccataggattgctgctgtcttccccgcttcccactttgctgtctttctggagccccag

SEQ ID NO: 45845 - DNA, 873 bp, Homo sapiens
gtggcagacaagagagtttgtgcagggaaactcccatttatgaaaccatcagatgtttgtgagaccaggagtttctctacaaatggatgaggaatggcacagaatcctaggtgacagtttaaggattgcatggcagaaaaggctctgtgattaaattctctgatgttgtcactgagctgtaaggctggagataagactgtctccttctgctgaaaataagaatcaatactcactccttgatgggctaaactattaaaaagagcccttcttacaatgtttcattatctgggatttgcctcagctggtgatttgttggtggcacagggagatttgtgaggcatttcatattaaaattagtcagtagccggtgaatccctttagataattctcttccgttttacagtgctcctgaatagatttgtgatttatttttgcctaagtagctttgtgtttttttggaattattaaaagagggttggacatctatacactttttttaaccttgtttttcctcatattctctgtgtttaacagtttagtattggccttagcaaaaaacatcaaatatatttgcgtggtacattgacctgacacttgattaacacacgttgaacttgatgtttttcccgtatgaaggaagttatacaagaagttggccttgcttttttcgttgattttaaccgtggacagggttggggttgttaattgttaggtggctggtaggatttcagctcctcgattgaaaaagaaaaacagcccatctcgtgaacctcagtgaccaaaagaaatggtcactgtgtcatttgggtgcttgttgtgtctcatcccagtgtagtgtgatggctagggagcaaagagaaggcgagcctctga

SEQ ID NO: 45846 - DNA, 484 bp, Homo sapiens
agtcatctgttcaccccagggaagactggttgacccagtatgtggatcatgtgtaccatggcccattgagtgggccaccatgataggtggtccacctttacccatggacaaagggtaaggaagctcttcaaagccaagaggagacttaaagaaaatggagatgaggtagattctgaacctctccaaacgatatattttcatgatggcagggatcacacatgttgggttctagaggtatttaaaaagttgtttttaataataattttaaaaacccaccaaattgtttcttaattaattaatctttgctattgacccaagcaaggagtttatagtgcttagaaatgcattgctataaaatgacaactagaattccttcctcacttgtcaaagcacaggcttttagagagagagatatttgtagaaagagcaaatctgtttctgattttagttcatccagtggcaggcaggctttttggaccaatta

SEQ ID NO: 45847 - DNA, 600 bp, Homo sapiens
ctttattcacatttcttttatttggctttattacaataagcctgtattacatttacaattaaagtccaacaaacttttaaaaaatgtacaatatgaagcaatttattttaaagacatatcttataaatgggaagacatcctatgttcatggataggaggacttaatattgtttagatagcagtacttgccaaattgatttatgaattcatgtaatacccatcaaaattccacctggtttctttgcaaaaatcgacacgataatcttgaagttcatatagaaatttgagagcaccagaatagttaaaacaatcttgaaaaagtagaggaacaaagttgaaggctctcacttctcaacttaatacaaagctacaaaaatgaagacactgtggtactggcacaaggacagacatgtagatcaatggaataaaactgtaagtccaaaaataaacccatatatttatggtcaattgatttttgacaagggtgccaaaatcactcaatggtaatgggacaagtagacatctacaggcaaaagaatgaagttgaacccttacctcacatcatacaaaaaatgaactcaaaatggattggagatagct

SEQ ID NO: 45848 - DNA, 388 bp, Homo sapiens
gctcaacaatgctaaaaataaagacagcaacatctgggcagaatttcccctaattttaaagccagtagtggaggtggaggaagaaaaatcaaattctcattcaactaaaataatctaggaagacactacgtggcttcttggaaataaaatcaacaatttataagatttataaggtggagattgtcttagttcattcatgctgctacaacaaaatagacagggtaatttatgaatagttgaaatttatttctcacagttctagaggctgtaaagtccaagatcaaggcaccagaagattctgtgtctggtgaagggcttgctctctgctccacaaatggcaccttgttgtgtcctcatatggcaagagggcaaaaaagacttgggtgtt

SEQ ID NO: 45849 - DNA, 637 bp, Homo sapiens
cctcccaggttcaagcaattctcatgcctcagcctcccaagtagctgggactacaggtgcccaccactgcgcccggctaactttttgtgttttagtagagatggggtttcaccatgttgctcagggtggtctcgaacgcctgagctcaggcaatccacctacctcagcgtcccaaagtgctgggattacaggcaagaaccatcgcgtccgaccctaacttttcattttctgtttggaataaaaacctataccaactataaacacacacacacacacacaattgccatttataattgtagtttattggcaaggatggtctaagtttgccaggtctaagtgttgtaggtgaagggtgctacaaatgagatacaacttcagaagacatctctagggactaaagactttacattgggcaggcagcaacttttcctgcttgttaattttagacctgacagttgaatttatgtttgagcaattttagctgataaatgcattttttaagtaccttcctcttttggcattttaatttttactttcgtttttaaaaaattgcaaatcgtgaatgaatgtgcatattaaattagcatgctactaggcagggaaacaatgcattttcttttgataccttctcatccat

SEQ ID NO: 45850 - DNA, 410 bp, Homo sapiens
atctgttctgtctcagtgctctttttcgtagtaaatatcaccaccattccacccatctgccccagacagaaagagacagcatccttaacaccttcatttccctaatctgttacatgttttctatcaccaagtcctatctcctaatatttcttgcttttgtcctgtccttatttatcctactgcccctgtccttgtccaagcgacctacatcttcccctggaccactgtagtgtcctctcagctgttccctaggctgccacttgtaacccatcacctttcccaaactgcctcccctgtccctttcactggcttatcacatgttacctgaactctacacttcagtctctcccacctgaaaagggctgaaaatattgccacctccctatttgctatgggggttgtgtttttaa

SEQ ID NO: 45851 - DNA, 430 bp, Homo sapiens
ctcgcttagaaaggttacccccattgggaaaaaaaaatggtttgggtttccaaaagccctatttaaatttgtaaggatatattgagtacctccccagacccaaggtttttttccttgccagagaaacttttttgttttattcagtgctcatataacaccctagcacccgtgccttgtcagttagcaatcaaaattaaacattgtaagaatgaatattttgaagtcatcaattccctagttattatatagagtagatacataatgagctcaccattctgtacttttgctgtatttttcatgatgatgtgaattttgaagtaaaaacagtctagttatattttgtatatttcacattaacatactgccagatagagttgcttattgtaggcatttctgcgataaatatattttccaaagcaaaaaaaaaaag

SEQ ID NO: 45852 - DNA, 367 bp, Homo sapiens
atggaaaagttacagaaagaaaataagtgttttaaaatactcctcatctatataaaaatgtgaaacaatcactctgcctggcgtattatttaataagttaaatatcttagttgtgatggaagtttcacagaaatatacatatgataaaatgacttatacataaaaacgagtgcacgtgtaaccgaataactctgtgggttgtaccaaggtcagtttcctgcttttcataatcaggtactgcagttatgcaagatgttaaatttgggagaagttgggtgaagtgtacactggatctctctgtagatttctttgcaacttcctagaaattatgactaattaaaatcttaaaagtttcttaaaaagtaaa

SEQ ID NO: 45853 - DNA, 516 bp, Homo sapiens
gatgacaaattgagcaccttgttatatgtttattggccatttgaatgttgccttttgtgattctgaatctctttgtaatgcttaccagttatgcaagtaaaatgaaaagggtggttctgtcagatcttaacccaaatccaaggtgaagcctggtttcctgcataggcgagaaggccccagggcccagaatccctcctcaccccttctgcctccatcccagggccccactctggggcaggcagtgctggctgcattcagctcagtggggggcagtttgactatgtcgcatccagcttcccatgccgtccatccctaggagtctgtctcaccatacaagggcgcagacaggccagcttgagggtgttcatcaacgcagcattgtttgaagagcagaagttagaatctattcattcgggggcctgactgcataaatacactgtggttgccgtccagcagagcatcatgcagccattaactgcactcacatgggaaaatgcccacaatggcttgttgttt

SEQ ID NO: 45854 - DNA, 490 bp, Homo sapiens
  misc_feature (19)..(19): n is a, c, g, or t
tttagtgaacttcccttgncccaagaaagaggggagccttatgattgggtatcccaattccacccaccacttaccgctgaactccatgccagaccgctcccgatttcttggacttcttaccagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctaactgtgcaaaattattttgccttggccgtgtaatgtgaggtttacctgattctctaatgaaataaatacctaagttat

SEQ ID NO: 45855 - DNA, 442 bp, Homo sapiens
  misc_feature (19)..(19): n is a, c, g, or t
  misc_feature (424)..(424): n is a, c, g, or t
tttagtgaacttcccttgncccaagaaagaggggagccttatgattgggtatcccaattccacccaccacttaccgctgaactccatgccagaccgctcccgatttcttggacttcttaccagagatgagcatcaggattttatggatgagcaaaaacgactaaagaagcttcgtggaaaggagaaaccaaagaaaggagaagggaaaagagcagcaaaaaggaaatagtgttggtccctcaagagggagactttcttcctcagtggcggagagaagaaagtgcatttattgtctttccacatattggaggaatgtcatcttcctaaatgaagtttatttggaggaacacagtcatctccttggtgaaatctaatccggttacattgtggctggtttcttgaacacattctataggttgtcggngtaccggagctccgaatt

SEQ ID NO: 45856 - DNA, 418 bp, Homo sapiens
gtatatttgcagctttgtgacaaattctagtgtatgggaaatggaggcaatctagggattcccatcgccacttaaatctgttagtgagctaagttacacacgggcagggatttctgtgtttgttcactgctgtatctgcagtgcccagaataagtgtctgacaaatggtagatactcgatgggtatttgtggaaagaatcataacaatagcataaaacagacttgcaaagtgctccctaaaaatgccaatacaatttcaacaaaagcagtgtgtcacagagagtcagttgggagccaatcccttggttgaggaagtatttccatatatggctctttttgttgttgctatttttcaaaaattatataatttaaaatcttcaaaaattgtaaaatgtttaacattaaaaagtaaaaaaaa

SEQ ID NO: 45857 - DNA, 446 bp, Homo sapiens
ttcaagtaatttaagtgtttaatacatactaaggaatataaatctaaaataaatatcaaaacaacccaagtacagtctcgtgtcacttaacagggatacattccgagaaatgtgtcattagttgattttgtcatcgtatgaacctagagtgtacgtacacaaacaaatggcacaacgtactatggacttaggttgtatagtatagcctgttgctcctgggctacaaacctgtgtagcatgttcctatactgaatactgtaggagttgtaatacaatggtaagtatttgtgtatctaaacatagaaaaagtattgtaggtcggccgcggtgctcatgcctgtaatcccagcacttcccagcactttgggaggttgaggcgggtagatcgcctgaggtcaggagttcaagagcagcctggccaacgtggtgaaaccccatctctgcta

SEQ ID NO: 45858 - DNA, 205 bp, Homo sapiens
ccccagaagacaagcaaagagataatgcagcaagccagctcatgtggtggccagagggtttggtgcaagagcatctgtagtaaagtgtggccagtgatggccatttctctaggctcaactgtctcccataagagactttagccctacgggaactgttgggcctaatttctgcaggatggtcttgcaaatcagaagaagctggtcc

SEQ ID NO: 45859 - DNA, 466 bp, Homo sapiens
atagaaagcaccaggtagaaaccttgtttccttcagggaccagtacccggaaacaagggggaggacctaagcaggaaagccatagaatttggcatcagagacccccaattggaaacttccctgaagcctagagtcccctggttctgcgcttttccctctctctcatttctcatctgtgaaaagggagtaatcgctccccaaaagcttgttcatggtggttaatcagaatgtgtgagcagcctctggaggggtgcctcagctcgctgctgctgctgctgctaaatgcaccagccccctcctctcagttctactttgaagactgggcgagtgccttctggcctcgagggcaaccagggggtgtctgggaggttcagttcatgcaagggtcttgatatcattggaaggcttaaaggaagtggcttcaggagcacttaatgcttgaggtcaccctaaggtcaggttttgg

SEQ ID NO: 45860 - DNA, 261 bp, Homo sapiens
gagctcgtgctggggaaaagtctgccaaaatgctttaaggtggaatgtgtaaaagttctgtttcccagagtcgggctgggccaggggaggatccttgcagcccaggaggaggaaaagccactaagtcccctcccagggctggacaaactggagaccctttacagttgctgggtcaccagtgggggttgcttgaaacacaaacagtgcacctctaggcctgccacggagaggaacggtgcctttgaagcacaaaaaaaaaaa

SEQ ID NO: 45861 - DNA, 1018 bp, Homo sapiens
ggctgatttttgtatttttagtgcacatatatttcataaaaacaggattaacttggacatattattttataactgatctttatgtggtaaacctctgtatatatattttttttgttaattttttttttaatagagacaaggtctcactatgttgcccaggctggtctcaaactcctaagctcaagtgatcctcccacctcggccttcctaagtgctaagattacaggtgtaagccactgcacctggctgaacctctgtatatattaataaacatacttttcttcatcatgtttaataactgcataatattccagtatgtgagtttaccatatttaacttgctattggtcatctagattgtattataaacaacatgattaacataaatctctatgcccatttttaatttttttgggctacattaccaaagtgcattttaaaaattttaacaataatgttattcttctgaacattatcatcctgagtagatacttattgatagtaacaataataatttatttcataaaatctaaatgctactgattgtagaggcaccattgtttaccattgttttatgaccattaagaaagaaaaaacactgccagttatactatgaaataccactgaatctaaatgaaatatactgtatcaatttcagagatgttaaaataggagaggaaatgcatcttagaatcagtgaaatgccagtacataatctatttcatctttccaatacatgttggcaattcttgaatcaaactgtcatgtagcctgtgaggtaggcggccaagcagcagagcagtgaccttttacaagcattcacctaagcaacaaaccaaaggacaattaatccattagtcaggcaggttaccaggtgttcactgtttgcagactgcttcatgtgctaggagctagggacttcaattgtaaataccccagggttcttttcaggagcagcacagatttacaatcaacattgcagccacacctccctcccagccctcatccccacctaaaaa

SEQ ID NO: 45862 - DNA, 415 bp, Homo sapiens
ggaaaacctacttaacatgacacaatatttctaacaatttaaaacagttgggggaaactgtgtgtgtaaacacacacacatatatagttctaggtatatagaataccatatatataggtatgtgtatatatacagaatagataaaaaagaagcaaaggctaattgagcctcgaagaacaattgtgaatcaaataaaagtgagaaaataaactgaatttgattatatcctctacggaaaatattactatattagttatgcataaatttttaaagattgaaatatacttggatcatttgacattttcattttattgactgtagtgatgatttaagtcaaaatgtttcaaattgtagactttaaacaatttatattgtatataaattatacctcaataaagttattaaaatatactca

SEQ ID NO: 45863 - DNA, 600 bp, Homo sapiens
ggatggcgacatttcagtctaaaactgtaatgtatgattttatcttatttgaagcaacggggtaagttccataactttatagccatcgatgaacttccgttttggtcttagcttgccctgagtcccatgtgctgctctcttggaaggttccaggatttggcgaacaaaattgtattctccttttatgtggtctctttggggccgattgggagaaagagaaatcaatagtgcaactgttttgatactgaatattgacaagtgtctttttgaaataaagaaccagtccctccaaaaaaaaaaaaaagggtcggccgctcgcgatctaaaactagtcggacgcgtgggtcgacccacgcgtccgaaaagaattggtagctggggaatcttaataccaatggtgagtggctgttcggagttggcccccaccatgtccttagatctattctggtgctaccttattaactcacagcaggcttactgaagtggcttcattcagatttagtggatttctccaccaaattgcttgtcatgtattctcaataggctgtatttcccagcagtcaataaatgaacacccgtaaaatctcaagaaaaaaaaaa

SEQ ID NO: 45864 - DNA, 494 bp, Homo sapiens
cattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaaaaaaaaaaaaagggtcggccgctcgcgatctaaaactagtcggacgcgtgggtcgacccacgcgtccgaaaagaattggtagctggggaatcttaataccaatggtgagtggctgttcggagttggcccccaccatgtccttagatctattctggtgctaccttattaactcacagcaggcttactgaagtggcttcattcagatttagtggatttctccaccaaattgcttgtcatgtattctcaataggctgtatttcccagcagtcaataaatgaacacccgtaaaatctcaagaaaaaaaaaa

SEQ ID NO: 45865 - DNA, 326 bp, Homo sapiens
gtaatcccagctactcaggaggctgaggcaggagaattgcttgagcccgggaggcagaggctgcagtgagccaaaatgttgccactgcacttcagcctcggcgacaaagcgagactccgtctcaaaaaataaaaataaaaataacaagacttacacggatgtgtgggtctgtgttctctttcactggcccacccattcttgtcccataccacactcctctgatgatcaagcccacatacattgctcttcttcaacactggcttagattttcttgactctgccctgtcaaggaattttttttttaatttgtcatttctttgaactac

SEQ ID NO: 45866 - DNA, 349 bp, Homo sapiens
ttgagaccaaagactgactttcttctaaaatgctttctcaaaaagatttttaagaagaaatgggcggaaatgtgaaaggaaaataaaccttggggccctgaaatcactaaggtaaaggggaaagtcaagctgggaactgcttagggcaaacctgcctcccattctattcacagtcacccctctgctcacagagataaatgcatatctgattgcctcctttggaaaggctaatcagaaactctgaagaaagcaaccatttttctcttatctacctatgacctggaagcccctccccacttagagttgtcccggccttttccggacggaaccactgttcatcttacatatg

SEQ ID NO: 45867 - DNA, 442 bp, Homo sapiens
aagttgtgtggttctaagatctgtaagctgttaaccccttggatggcaggagtttttctttctaatctttctacttcccactgccttttgcacatagtaggtgtggtaaatactaaatgaatgaccgatgagatggctctggtaatttaatgctgctcttctcaaaagaggaagaaaacctcactcagaaccgagggatgcaaaaccttaattctctgagtgatgaactatctgagtcatgctgtttcaaagattcaggcttgtggcctaaactaataacaaattctttccattaagaaattgtttcctctggccaggcacggtggctcacacctgtaatcccagctactcaggaggctgaggcaggagaactgcttgaacccaggaggcggagattgcagtgagccgagattacgccactgcactccagcctgggcgacag

SEQ ID NO: 45868 - DNA, 392 bp, Homo sapiens
ggctgcgcaatcttggctcactgcaacctctgcctgccaagttcaagcgattctcctgcctcagcctcctgagtacctgggactgcaggtgcgtgccaccacacccggctaattttttatttttagtagagatggggcttcaccatgttggccaggctggtctcgaactcctgacctcaagtgatccacctgcctcggcctcccaaagtgctgggattataggcatgagccactgtgcctggcacagggtcttctttcagggtggagtaactttgtaccactgttagtcagtctccctgggttgggaaggacaggaaaggactgtacccactgctgagacacagggagtctgtccaactatgacatcatcattgttacatggtgaggtgggg

SEQ ID NO: 45869 - DNA, 731 bp, Homo sapiens
actgggttgtaaatctgttattctttttctatcaatgctatatcttcaaatttatacatgttgctatgtgtaagttgactttattattttttactgctgttcactactaagaaagaccatttgagaattttccccaatgccttatgaattataatgctttcctttctcgacggtggaaacagatactatttcaggccctgtgtgttgattggatactgttctcactaattcttttaggtgccctcctcccttcctccaccttggttagtgtcctcatctgcacacattcattcattacttgaggaagatcctctgtaggttttcaggcttctctctgtgtgcagctttcttttctccagtattctttcttgcgagctttagcgggtttggtctttctgtactccaattacatctcctccacttagggactccactgagttccatttggtcttgcttccctgcactgcagcctggaaactctttgaagacagaaaactggggtagttgtagggcctgcctcatttgtttcacatatttcagggataactgtccttacttgcctgatgtctactgtcttgaaactcattgtttactatattttattccacttttggtttgttttgttttaggtcagttaggaaagcaaattcagtccctttcatcatatcttggctagaagctgaataatatgagaatttttagagtaatttaattcacctcatcagtatttg

SEQ ID NO: 45870 - DNA, 426 bp, Homo sapiens
gaaaaatcaatcctgatatattactaataactagagtccatagtttgtattaaggttcactctttgtagtgtatagttctatatacacaaagcatagtatcatgtatccatcattatagtatcccacagaacagtctcactgccgtaaaaatttgtgttccacctatccaaccctccctcccccaactcctaacaactaccgatgttttcattatctccaccgttttatcttttccagaatgtcatatacttggatcaatacagtgtgtagctatagctttagactggcttcttccacttaggaatatgactctcagtgtcttccatgtatttttatggctcgatagctcatttatttttagtgctgaatattattccattgtatgtatgtaccacagtttatttcttcatccattaagggacatc

SEQ ID NO: 45871 - DNA, 471 bp, Homo sapiens
cagctgaaacctttctcctaacaagataagaaccttctgctggtgccttctgaaaacccagataggactgagaactgacctgtttaactcatcaactccttattagatacctgcagtgagccaaggaccaggctagttcctgtgatgctgaagatgttgaagggaagcccataacattacaacgttgaccaatcctccagaaaagaagctctaacagaggaccctgggctgtctacggggttggtttccatctctccattcgtgagctccttgaaggcagagaacacttgggcttttcttcctatacctccagtccctaatgcaggggacatggaggagatgcccatttgtgtttgatgaatgaatgagtgaataaatgaatgaatgagtgcctggagatcagagtacatgggatgagtgttcggagttctacagactcaggaagccccagctgacattccaagaagaagg

SEQ ID NO: 45872 - DNA, 339 bp, Homo sapiens
catgatttatttatgcattccttgtcagtgaacgtttaggctttttcagtttttctgctcttaggaacaatgctgccaagaacagtctttgcatgtctctaagagcatttatgaatttacctataatatatgccaaagggtagaattgctagatatatgtaggtccaggttgagaagatgatgccaagtcattgacactatgtttttgtagtgaaggtgccaatttactttcgtttccaccagtagtggctaagagttcctaatgacccatatccttgctaacagcttgtcttactagaacacaagcaatggaatctcaagctgcagcactttggggcc

SEQ ID NO: 45873 - DNA, 483 bp, Homo sapiens
gagctcttcttatctctaacatggtaatacccatgtaataaagggagtcttgccattcactgattatgacaaaacatttgatctgttgtttcaagtaaatgaaaatgagaaaaacactagcactacatgtaggaagaaaaaaacatatctgaatgggaggtgtactttcataaacgttttgaagactgccctccagaaatgaaactgtccatggatactgggttcacagctgctaaaagctgcctcagactgcccaaacacaggctgaatattgttatatgggattggtatcgacatgcaatgtagactggtccctggcctgctttgggactctagcccccagtaatttgtactgcgttcctgtcagtcctaactccagcagcggcttaaaggatacaatcattcagtacaatgaaaatccctagcacatgacttcttaggctcttgctaaatatctttaggaaaatgtatgagaaaagtttt

SEQ ID NO: 45874 - DNA, 374 bp, Homo sapiens
agacagggccttgctcccatcacccaggctgaagggcagtcacatcactacacccttgacttcccaggctcaagtgatcctcccactcagcctccctagtacctgggactacaggcaggcttcactacacctggataaattttttgtatttttatagagacggggtttcaccatgttggccaggctggtcacgaactcctgacctcaagtaatccgtctgccttggcctcccaaagtaccgggattacaggcatgagccactgcccctggccagtttgtgttcttttaaaacatcatttgaagtttaacttaaatgttttacaattaaaagtggaaaattatgggacactcagtgtttgttacccatgaaagaa

SEQ ID NO: 45875 - DNA, 857 bp, Homo sapiens
ctttttttttcttttacaggattctaaatgttccccttgccaacttttttgttgttcatcatcaccatcctccaggagcctttttaaacttttttttcgtggatcacctcctcatgaaatatgaacacaaaagtcacatgacatatctatgttctgtacattacatctgtgattatacagtaaaaaataacaagatttcactcccaagaatcaatttctcttccttagggacaccgtgtcctatgtagagaatgcagactctagaattattcattcccaaggtgattctcagattctctattttcatttatagccatatcttctggagcagtgaatttcacagcctctggtccccttcacccttggacccttttagggaacccaaagagctttgtccgtggggattctttctttttttttttctcctgagctgaggcttgctctgttaccccaggctggagtgcagtggcacgatctcggcttcactgcaaaactccaacttccccaggttcaagtgagccctccctccgcagcctcccgagtagctgagactagcggtgtgcgacacccacattcggcctaatgttttgttttattttttcgtagagacagggtttcatctgttgcgcaggctggtctcaaactcctgagctcaagtgatccgcccacctcggcccccaaagggctggaatgacaggcgtgagccactgtgctcggccatgtccctgtggattctctctctccatatttagaataatcgatattaaaactgagaaattagaaagcgtatttatcaatccctttaaaaaaaaatcaaaccattatgcagtaacataaatttcataatttttcattaa

SEQ ID NO: 45876 - DNA, 608 bp, Homo sapiens
cctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactggggaacaagaacttttctttttccacgatttgagtcctggaagctgttttttccttcccagaggagccttcatttataatacgcttacagatttcatacgaatgcaagacagatgtggctgatgaacaggagcagggcctgattgtgagggtcaccaaactgtaaaggcacttaaatgcacaaacccagtg

SEQ ID NO: 45877 - DNA, 2300 bp, Homo sapiens
cctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatcttctaaactggaatcattacttaattttaactaaccaacaaccacaaaagcagcagctactactaaatattggattactgacaaaggaattcagttttgtggaatctggtgtttgcactataggttaagagttgccatttaaatgtttcttattcataattaggttttgttccgctttagaaaaaaataaattcccaaatgaattgca

SEQ ID NO: 45878 - DNA, 848 bp, Homo sapiens
cctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgaagaccgtgttagccaggatggtctcaatctcctgacctcgtgatccacccacctcggcctcccaaagtgctgggattataggcatgagccaccaccgcgcccggccttttatttttttattttatttttttcctaagatggagttttgcccttgtcgcccaggctggagtgcaatggcatgatctcagctcaccacaacctctgcctcccaggttcaagtgattctcctgcctcagcctcccaagtagctgggattataggcatgcaccaccacacccag

SEQ ID NO: 45879 - DNA, 410 bp, Homo sapiens
ctggacttccaactgcctattagatttaatctcacatatgttaggtgagtgattgaatgtgataaatattatagtactgatattctaattttttgtcatttgagtattagcaatgcaaaaataaacattagtgaatgtctagtatatgtgctatacacgcaatatatatttgtttacctgatcataatccagttgcgaatcaacttgaattttctggtctagtagcgggaggaagataagtaaacatgagagtagagatatgaacaaagttccatgaaaatatgatccaggctgctgactctccctgagttacagggggaagacttcacaaaatgctggcattgggtctgtgtcttaaggatgagatgttttcttgaaaaagcaggggaaaaaaggcaattttatcactg

SEQ ID NO: 45880 - DNA, 711 bp, Homo sapiens
gaccagggggtgactgaaaggaagttagtccatgcatagcggaggctgagtgctgctgggagcaccgcgactctgcagtccatacagatgtctcccagccttggttccatagccagtgagggcagggacgtgatgagcactgcatctggctcttgagcaaaactaaagcatgtgaagggtaaggaagaccacacaaaagaacaggcctcagaggagctcacagtccacctgggtgtctcctagcagggcttccttctccccttgcagcagaggagaaatgaggcaggtcttggcaactgttgatgcccagtctccctcactgagacacaagagtagtgactgtatgaacgtttgactttctgaagtcctggaacaataagacagcagattcaaatttatggctgctgaggctccaggacaaaggaaagagggaatgcataatgtctggaagatggatgtcggttctctgctcttctttttagagcagtgtccagcacagaattgtcagccctggagaatatatgtaaagccatcataaaagaaaagcaaccttttgaaagactagaagtcagcaaggaaatcctcctggaaatgtttaaggtaacttggggaaactcctaaacctcttactaggaatattaaaaatcaatatagactagcttccccaccttcccccaaataattacctgttgctcaccaaattattccaat

SEQ ID NO: 45881 - DNA, 2496 bp, Homo sapiens
cctgtgctacggtccgcccattgaaaatggattttattatgacatgttcattgaagacagagcagtgtccagcacagaattgtcagccctggagaatatatgtaaagccatcataaaagaaaagcaaccttttgaaagactagaagtcagcaaggaaatcctcctggaaatgtttaagtacaataaatttaaatgccgcattctgaatgagaaagttaacactgcaactaccaccgtgtacaggtgcggtccattaattgacctttgcaaaggtccacatgtaagacacactggaaaaattaaaaccatcaaaatttttaagaattcctcaacatattgggagggcaatccggaaatggaaacattgcagaggatctatggaatatcctttcctgataacaagatgatgagagactgggaaaagttccaagaggaagcaaagaaccgagatcacaggaagatcgggaaggaacaagaacttttctttttccacgatttgagtcctggaagctgttttttccttcccagaggagccttcatttataatacgcttacagatttcatacgagaggaatatcacaaacgggacttcacggaggtgctctctcccaatatgtacaacagtaaactctgggaagcctcaggccactggcagcattacagcgagaacatgtttacctttgagattgaaaaggacacttttgccctcaaacccatgaattgtccagggcactgtctaatgtttgcccatcgtccacgatcttggagggaaatgcctattagatttgctgattttggagttctgcatagaaatgaactgtcggggactctcagcggcttgaccagagtgaggcgcttccagcaggacgatgctcacattttttgcacagtggagcagattgaagaagaaataaaggggtgtttgcagtttttgcaatctgtttactcaacatttggcttctcctttcaattaaacctgtcaacaaggccggaaaacttcctaggagagattgagatgtggaatgaggctgagaagcaactgcagaacagcttgatggactttggagaaccgtggaaaatgaacccaggagatggagcattttatggccctaaaattgacataaaaatcaaggatgctattggcagataccatcaatgtgctacaattcagctggacttccaactgcctattagatttaatctcacatatgttagtaaggatggggatgataagaagagacctgtgatcattcatcgagccattttgggatcagtggaaagaatgatagccattctttcagaaaactatggcggaaaatggcctttctggctatctcctcgtcaggtgatggtcatccctgtggggccaacttgtgaaaaatatgcacttcaggtatccagtgaattttttgaagaaggatttatggctgacgttgacttggatcacagttgtacactaaataagaaaatacgaaatgcacagctggctcagtataattttattttggtggttggagaaaaggaaaagatagataatgctgtaaacgtgcgaacaagagacaacaaaattcatggagagattttagtaacttctgccattgataaactgaagaatctcaggaagacacggacactcaatgctgaggaggccttttgaagtccttccctgatatttgcttctgtgtaactttgttttgacccttaaaaatgtatttttcttaacatgttagtacttctacgactttggagccactgatgggtccactcatggcctcagctgagaaaggagacgatgaacgtgtagctgacatgcacgaagtttaatttactcatgtccacgggggacgtttagagggcacgtgggaaattttccagcaatcaatgccttgagaaacttaaatggggaaatattattcatcgagaaagtgaaacaaaacactaggaaatgattatgaaatgttagtgattttcaaaagatgggcttcaaataaaagtctgcagagttttttttaaataggagggaaaatcttattttctaatatgtctcaggtatttttatgacttctactaaaattcacactgaaactttatcttctaaactggaatcattacttaattttaactaaccaacaaccacaaaagcagcagctactactaaatattggattactgacaaaggaattcagttttgtggaatctggtgtttgcactataggttaagagttgccatttaaatgtttcttattcataattaggttttgttccgctttagaaaaaaataaattcccaaatgaattgcatcagtgtttccagcgtttcagctgtgggcttctaccaccactaagccgctcacctagagttgttacttttttgatgggatgacattccatggatttatgtactgaaatggatttcagattttaaagagaggaatgctctacgtgctcagaactgaattaaaatggcattatgtcaatagagaattcagctaccaaa

SEQ ID NO: 45882 - DNA, 461 bp, Homo sapiens
aaacaacaaacattgatgatctcacagttcctacgagtcagggtctgggagcagctcagctggtggattctggcgcagagcgtctcctggggctgcagtcaggctgtcggccagggctgcggagctcggggctcgctcacagttggtggatgcagctcctcatcacctgggtgcttgcttgcctgaatgtcctcactgcatggtggctggtttcccccagagcaagtgatctgagagagatgggagctgcagccttttataaactagtctcagaaacgatgcgccgacacttccgcacttctttatggtcacgcagacccgctctggtatagtgagcagggaactatacaaaggtgtgaataccaagagtggggaacaacggggtcttcttggaggctaggtaccataatgtaacagtaaaggtgtttcattttcttctaggtatccagtgaattttttga

SEQ ID NO: 45883 - DNA, 386 bp, Homo sapiens
tgtgcctttatactacaaaaaaactatatacttttataatatacaatctggtgagttttgaaatacgtttacatctgtgaaaccatcgctgcaatcaaaataatgaatatatccatctctcccaaaggttttcttctgcacttttataaataacccctgcgccatcaccaggcaaacactgatttatttcgttactatcagttttcattttctagaattttaaacaagtagatctgtacaaatgtatttttttgttttgtctggcttcttccactcaacataattgagattcacctttgttgctgtgtgtaaggataattgatttctttttattgatgagtagtattccactggatatatacatatattatatatatatacacaca

SEQ ID NO: 45884 - DNA, 615 bp, Homo sapiens
ctcccgggttcacgccatcctcctgcctcagcctcccgagtagctaagactgcagatgcgtgccaccacacccagctgatttttaaatattttgtaaagatgttgtcttgctgtgttgccctggctgatctcaaactcctgcactcaagcaatcttcctgcctcaagcgtcccaagtgctgaaattacaggcatcagctaccgagcctggagggtcgttactaaagtgaaaaagtgcaggacagagatgtaggagctcaggcttcctctgatggtgacagaaccaggggaagttttttagctgggtccttgtgtggttaaaatgggtctctctggccaggcgcggtggctcacgcctgtaatcccagcactttgggaggccgaggcgggcggatcacgaggtcaggagtttgagaccagcctgagcaacatggtgaaaccccatctctactaaaaacactaaaattagcttggtgtgatggcgcctgccgtaatgctagctactcaggaggctgaggtaggagaattgcttgaacctagcaattctaggaggttgtggtgagccaagattgtaccaatgcactccagcctgggcgacagagcgagacctcgtctc

SEQ ID NO: 45885 - DNA, 478 bp, Homo sapiens
tacacactcacttgttgtctaaaagtggctttgtttgaatgctgtacaaaggtaaatgactcaaacgactgtgttggatagatatgtaccttctctcttcatatatccaaagacagtggttgcaggcaacagcaaaaattaaaattattacagcataatgaaaacacatgaatgttattatctgactctaaatattactgactttttctttttcagagaatattttaaagtgactttgttttatcttagtatgcctgaataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaa

SEQ ID NO: 45886 - DNA, 940 bp, Homo sapiens
cgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaa

SEQ ID NO: 45887 - DNA, 561 bp, Homo sapiens
gtccataacaccatcatatgcccaaatgattgtccacaaggcacagttgaggattctaacactaatcataattaattcaaatgttgtaccataactttatcatagtaaatttatacagtctcacatggaagtactgttgctatagcatagttgataaatacaagaaatgtcttcaattgttgctgcacaatttctttatttaacattttaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacaggtattcagttcttaataacatattgttcctttggaaactaaaacatgaagctaagatctgtaacatatgttgaaagacactatcattcaattgaaacccaccggtaaacttctgaaattgattatgataaaacagaaattttgaagtattttacttctaaatggatacaccaccaccatttaatgtttgttaaagcagtgc

SEQ ID NO: 45888 - DNA, 1072 bp, Homo sapiens
cgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggtggcgtctcaccaagcctcagaacgacttacataaggggcaacaaacactcctctttttttccttctccttaactcttcttttaggttgacatctaatttgttttaaaaatttatttgttttaaattaatttgtttttaaaaattaagtaaagccttgggatggggaaaaggaattttattattttatgtgtttattcaagaagtaattttcaacctatccaagttgatcaatggcagacagctttgatttttgcccccctactcctgcctgtagtttcagcttttactccccacattatttctgtgtgcttgaagatttgctctaccttgtcctttgtctcctattttcttgcatttgccctgcaaagaaagatcagatcacatacacaaagctgtaggtaatatagcagtgtaattacatacaacttcctactacaagatttagttcttttaggccaggcgcagtgactcatggctgtggatcatttgaggtcaggagttcgagaccagcctggccaacatggtgaaaccccacctctactaaaaatataaaaattagccaggcatggtggcgggcacctgtagtcccagctacttgggaggctgaggcaggagaatcacttgaacccaggaggtggaggttgcagtgagccaagatcatgctactgtactccagtctgggcaacagagtgagactccatctcaa

SEQ ID NO: 45889 - DNA, 1125 bp, Homo sapiens
cgtgaccgacgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggtggcgtctcaccaagcctcagaacgacttacataaggggcaacaaacactcctctttttttccttctccttaactcttcttttaggttgacatctaatttgttttaaaaatttatttgttttaaattaatttgtttttaaaaattaagtaaagccttgggatggggaaaaggaattttattattttatgtgtttattcaagaagtaatttaaaatccaaattcaattttaactagcagaattctagagatactttggtctcagtcaacctatccaagttgatcaatggcagacagctttgatttttgcccccctactcctgcctgtagtttcagcttttactccccacattatttctgtgtgcttgaagatttgctctaccttgtcctttgtctcctattttcttgcatttgccctgcaaagaaagatcagatcacatacacaaagctgtaggtaatatagcagtgtaattacatacaacttcctactacaagatttagttcttttaggccaggcgcagtgactcatggctgtggatcatttgaggtcaggagttcgagaccagcctggccaacatggtgaaaccccacctctactaaaaatataaaaattagccaggcatggtggcgggcacctgtagtcccagctacttgggaggctgaggcaggagaatcacttgaacccaggaggtggaggttgcagtgagccaagatcatgctactgtactccagtctgggcaacagagtgagactccatctcaa

SEQ ID NO: 45890 - DNA, 385 bp, Homo sapiens
tcattctagagatgaaaattgagactcagaaagattaagtaccatgtgcatggtcacacaggagagtcaggtcagaatttgagaccaagctctagagtcagagctcttcccccactgtcccacctgccgaaaaattccaatcagaaaaagctaacaatgtactgccctttccataagttacaataaaatagtcagtaaaagtgatccctctaactataaacaaattgatttaatcaaaaagagctcttaccaaagaaaaaaggctagaaaaggaaaatggttattcacaataatcttccatcgaagttttattagtgggaaacaagtaccaattacactgcaaattttaaatcctaaatacaaactgactacatgactctacaat

SEQ ID NO: 45891 - DNA, 472 bp, Homo sapiens
gatggctgttagagcaggcatagaactgatgatcagctggcatagttcaaagaatgccgtgactcagccccttgcccacatgtctttggcaggaaatactgccagactagactgatgtctagtacaggaagtccattacagagaatggttgatataaagcagaaattcagaaccaggagagtttggggacatggagcaggccaaagttggagaactggaatttgacctgaaggtgagctccttgtcctcttcctgcccaaagtcaatattaaccccttggattgaggcaaaactgagccaaaagggagaccaaagtgactagagctgtctgcattgtagtaacaggtctggccaaacaaatacttgttagttgaatggatagaagtaagacagggaaacattatagtctttccacttaggttcttcatgtgacatacactaggtatcatgttacctactcaccaaaaaaaaa

SEQ ID NO: 45892 - DNA, 371 bp, Homo sapiens
agaaaggggcagcaactctacagacatttaaagaaaacactcaagaaattcaaatggaatgaaatgacatactatgcactcatattactgtgctaaacgatttaacatttaacaaacatgtgaataaatatgcacacaacaggcttctatgaacattctccttacagtgcagatccattcagtgttggactagtcctgagcagtgttgttctaaggagccggtaggcaccatttccgttttgcttctttgctttctttgttgctgtatatttcaacaggaagccctggcggctgttgcttaacagaagatgtcttttgttagtgatcaggaggctccagctcagcacactcacaatcaaagctactgtcca

SEQ ID NO: 45893 - DNA, 340 bp, Homo sapiens
ttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaa

SEQ ID NO: 45894 - DNA, 336 bp, Homo sapiens
cgtggtaggggctaaatgacttttccaatgtaacacagctgggtaagccaggttttgaacccccaaatacagttctttattaattctagcttaaaagcagacacccttataaatgaaaaggtacagaaacctttggatgcaaaaatcttaaatgtgaaaaggtggttcttagagtattgcaagggtgggtgaaaaagccatcctagtttgtgagtttgaataaaacatggtcttttccaactttgtgaaatgtgtcaacacccaccctccctttttcctgtattttccttgggagtgaggtgtgttgtgcttgggatagatggaagggctcttaag

SEQ ID NO: 45895 - DNA, 648 bp, Homo sapiens
acttatcacgtacctcctgcacgcttgatttcctcttctgtcaaatgagtagttgtaccaaatcttttatttagtcattaaacatttactgaacatgtatgggtgattaacactggatgttggatgttcggagaaaaccacaacagttttaataccagctacatttaattgggcaaaaacagtataccagatgctgtcttagctggtcatgccatttaatttgaagagcaaacctaataggtggcctatgaataaatctattctgtctctgtgggggttggaaggcatgttgctggaaattccccgtgaggaaaacaggctcagacggtttgggataatttgttctgggttacacacatctgacatacctgaaagtctggaaaatcccaaagccccagacctttgtcccccacactagactgcctctctaggtgagcaggagtcctgttgccctctgtgagggtcaccgtatttgcagcatgatgtgaaagtaaatattcagtgacagcaccaaaagggctttaatcttttttgactctgcttgcttaggtctgggaaggtgtctcagaccagccctcctattctctttaaaggttagccgatgattgcgttttcccctcacccagtacttatgctgccctgcccaga

SEQ ID NO: 45896 - DNA, 4065 bp, Homo sapiens
  misc_feature (1)..(3): n is a, c, g, or t
  misc_feature (6)..(6): n is a, c, g, or t
  misc_feature (11)..(11): n is a, c, g, or t
  misc_feature (14)..(15): n is a, c, g, or t
  misc_feature (316)..(316): n is a, c, g, or t
nnntcnctcanctnngcctcccaaagtgctgagattataggcatgagccactgtgcccagctgaatggacttttttaacgggaaagtttcattgaatttgctactttagtttttgctaaaccagcctcccttaaccctaccttcttctcactaaaaaacaagtcagtgtgaaagcaattaaaaccatatattcattatccatgtatttattgcttttattattctgtttagtgagattgccccagcttaggaaaggaattacttgatttttctcttttttgccccagacatggagcccaaacctgcaaccaagaangctacacgaacaaaggctatttctgaagatttatcacaggaggccatactagagaaacttacagagaatggtctgtgggattccagaatggaagggttatggaaatggaatgataggatattgagattacaaaataatcaggagaatcatttgagtcaaagaataattccactcaagaagactcccactagtcaaagaggctttagatttgaatctattcttattccagaaccaggcattgccacagaagagcttcacagcagatgccaaacacaagaggaaaatttcacagagaatttaaatttgattacagatacccatttggggaagataatttgcaaggagatgaaaggcagcaaagccataaggcagacttcagaactaactttggggaaaaaatccaataataaggaaaaaccctacaaatgtagtacatgcgaaaaggcctttcattatagatcattgctcattcaacatcaaagaactcatactaaagaaaaaccttatgaatgtaatgaatgtgggaaaacattcagccagccttcatatctcagtcagcacaaaaaaatccacactggagaaaaaccctataaatgtaatgaatgtggaaaggccttcattgcttcttcatcacttatggtacatcagagaattcacactaaagagaaaccttatcagtgtaatgtgtgtgggaaatcttttagccagtgtgcccgtcttaatcagcacgaattcaaactggagagaaaccctataaatgtagtgaatgcgggaaagcttttagtgataaatcaaaacttgcaagacatcaggaaactcacaatggtgagaaaccctacaaatgtgatgattgtgggaaagcctttaggaacaagtcatatcttagtgtacatcagaagacccacactgaagagaaaccatatcagtgcaacgagtgtgggaagtcttttaagaataccacaatttttaatgtgcatcagaggattcatactggagagaaaccttttagatgtaacgaatgtggaaaagcctatagaagtaattcaagccttatcgtacatataagaactcacactggggaaaaaccctatgaatgtaatgaatgtgggaaagcattcaaccgcatcgcaaatttcacagaacatcagcgaattcacacaggagaaaaaccctataaatgtaatgaatgtgggaaagcattcattaattattcatgccttactgtacaccacagaatgcatacaggagagaaaccttataaatgtactgaatgtggaaaggccttcatgcgttcttcttctctaattatacatcagcgtattcatactgaagagaaaccttatctgtgcaatgaatgtggggagtctttcagaataaaatcacacttaactgtacatcagagaattcacactggagagaaaccatataaatgtactgactgcgagagggcattcaccaaaatggtaaatctcaaggagcatcagaaaattcatactggagtgaaaccctataaatgttatgactgtggaaagtcctttaggactaaatcataccttattgtacatcagaggacccatactggagaaaaaccatataaatgtaatgaatgtgagaaagccttcactaatacatcacagcttaccgtgcaccaacgaaggcatactggagagaagccctataaatgcaatgaatgtggaaaggttttcacaagtaactcaggctttaatacacatcaaagaacacatactggagagaaaccatttaaatgtaatgactgtgggaaagcatttagccagatggtacatgtcacagaacatcagaaaatccatagtggagagaagccctataagtgtgatgtctgtggaaaagccttcaggaggggttcttaccttacagtgcattggagaacacacactggagaaaaaccctacacctgtaaggaatgtggaaagggttgtattactctatcacagctaaccctacatcagagaattcatactggggagaggccctataaatgtgaagaatgtggaaaagccttcagaactaactcagactttactgtacacttgaggatgcatactggagaaaaaccctataaatgtaatgaatgtggaaaagccttcaggagtagttcgagccttactgtacatcaaagaatacatcaaagagaaactcagttaatataaagaacaataagtcattcacctagatgtcaactccacaagatgaatcttataaactatattttatgaatataggaaaatcttcattaggaatttatcagaaagtatacagagaaactataagcaattatgtgggaaatcatttaataatattaaatcttagaagttataaggaaactctcactagaggaaaataatgaacaaatgaaagtgttcatccagatttcatactttactcatttaacaaattatctttagttaattgcctatatatgtatttgcctatttttctattcatttatctgtcttttcttataaacctggaggtgctttttatatatttttgatattaatcctttgtcattatgtagcagatgtttttcttaatctagcattgtctttatactttatagtaatgcacaacatttttataggaaaatatttgtatcatttcctttttagattttttattttactcattttacttaaaagagatctccttaatccctaggttatacgtagtatcctaaatgtgtttttaagatttttatgattttattttttacacttaagtctttaatccctctggactggatggttcttcataggagagcaactgtaggtgatcattatcctgtgaaaatattttgaacctaaaaagcactcagggaaatgcaaattgaaatgctcagtgagatgaaacttccccttcatggatctggcaaaaattaagagatcttttgctagctattggggtttgggaaaccatgtactattacttaaaggttgtgtaacatacttccaccagcagtccaacaatatatgtttaaaaatttaaaacatatatactcttagacccagcagtctcacttttggaatctgtccgttagaaataaaagcagcatcaatgcataagaatgtaaataaacatgtttgttgaagtactgtttgtagaggggggcaaagccccaactgcaaacaaagtgaatgcccattaatagggaactggttagataaattgtgacatacccatattatggaacagtgtgagagtaattttaaaaacgacttatatctatgctagctgatttcaatgtatttccacaatgtattgataaataattgctttataacaaatgtatatatacaatatatcatttttgttaaaataatcacacccatttattttgtgtttatgtgtgtgtgtgtggttagatgcacatggagacaggtatggaagaatatacaccaggctgttaatattgattaccttgaggggagtgagaaaaggagaagtagagataagggaaggggagactgtaaaaacagaaaaatgtaaatgctgcctttatggtataaaactgtaaatgtaatattatgtaattatgtgaacttttgagagagatgaaaggatggtctccaaaaaattaatgatggttatttctgttttagtggttcatcaattttttgttttttactttcttttctgtgtttttaagttaattttttccttgcaatgaacctgtaatatttacattaaaaggaaaaatattttcaaaaaaa

SEQ ID NO: 45897 - DNA, 349 bp, Homo sapiens
tgcaacttatttgtaaatttgaaattatttccaaataaaaagttaaaaaaaatacagcaaaaaaagttatatgagatggaagaaaataagtgtgggtaaatatgaaacaagatcggccatacattgataattattgacactgagtggtttactgtagtataaaaagaagtttattatgctctttgactactattgaatatatttgaaatttttcataatagaagaaggtaaacaataatgagggcatctgaatttgaagatcgctaattgtatttcccagctctaaagctctatggccatttgagtgtgatgaattatgtatgttaggtatgatcctattttttttttt

SEQ ID NO: 45898 - DNA, 1069 bp, Homo sapiens
cttgtcacaaaactgacacaaaatatttgctgaaagcttcattcagctcggcactttaggcagatttttgacatattttgctaacagaggaagaggctagggaagctgtcactctaaatctatgactgaacaacaaggtgaaactcagtatagaagtggaagtgtcagggctcatcgcttgccaggaagggaaaggctggcatactcagctgtgtaccctggacctcagccatgttgatttcagagggttcaattaaaaaggcatgattctggcatgtgctgccaaacaaagaatattaactctctacaaggtttcaaaaatgctattctgattgtgtgattaacaaatatcaatcagcctagattcagaaaatcatagttcagtttcaggaagagagcaacaacgtatttgctgttttgttttttaaagaatatggtgattttgaacaaaaagaagcctattaataacttagtaattggatgtgatcaccaaaaagccaattcagtcttacactgcacttaaaggaatatagtatctagcatgaggaaggtgatgattccattttcttccaccttggtcagatcatacatatatcactgtattcagttctaggtgtgtcattttaaagagaataaaatagtctcctgtcagagcaggactttcatgtttgcattctacagttgagatgttcatatacctgtatgtacatatgatttagttcattcttttcaactggaagtaattggcaaacttgtgtttctgcaatagtgtagagaaaaggaatctataaagacacagttaatttgtgaaaatataaagtattttctcaagtattcttgctgaaatttatgaaaaagaaacaagggagaatgcatgtacaacataagctaaattccttcctactaagggtagtgtgatgctaccactctgtaactgaacaagccattcaagatggtgatgttatttataagagtggattgttgacattggcaaatgtggtttgctctggaagtggttgtattctgtaacattttttttctcccagtaataaataaatatacacacaaa

SEQ ID NO: 45899 - DNA, 464 bp, Homo sapiens
agcaaaaaaaatatttgttgaatctcatcattccctctctcccttgcactctgtattccagtcctattgaactttcatttcatcctgttgatttgattctttcttgtccctgtgccttgtgtattatgtatgtgtatatgatatttatattatcatgtgatattacaggcagtactgcctgcagtactccctccatatacccatttattccttcttcttcttattctaaaaggttttcctgacttttgagggaaatagatcttccttctctatgtcctcactactccttgtactatccccaatatcatactctgtgccccttctggaaacaagaaacctgaaggcaggggccagatcgggtttgtttaccactgtatgccctgtacctggggcacttactgacatgaagtggttgttcaataaatatttcttgaataaatggttgaataaattttattcaaatg

SEQ ID NO: 45900 - DNA, 428 bp, Homo sapiens
ttttttgccaacacgtggtggttctaatttatcaactcttttattcatactgacagaagcaaaattgtaacatgccttgtagaagttatagttacgctaaaatcattaacctctttacttaaataagtgaagtgtgttagaatgttgaatctgattctttcattaatagaagaaaaattttacatgtattagtggatcacaaacatgctatttgaaggctgctttcttagctgctgactgttggctagttcattcaatgccagggagcctgctcaggcttctaaagtttacatgaaggaaaaccccaattttacatcacttttgagctagccatcttgtaaatgggtgatggtgattatcttaagggatccctggtaaataagtgtgaattgctgaatctaccactttatcacaatagtaaaaaaaaa

SEQ ID NO: 45901 - DNA, 285 bp, Homo sapiens
ctcctaattcagtcttacatgaaaccttaaagtagatgtaggcctgctctggttgaaactggaatgagaagtctggtagcccagcaaccccaaggccccctctgcatacagttcagaaaataacagatgggtgtgacccatcaccaccagaaaatcccaagtttttgaggtcccacccatagaggaggaggcctccaccctgctctgagcagcagggagggggctgcagagccagtacccgttccttagcatgtccaagtgctgtagacagagctgctgaggggg

SEQ ID NO: 45902 - DNA, 562 bp, Homo sapiens
  misc_feature (10)..(10): n is a, c, g, or t
tagaggatcnccgtcagacgctgaactatgtgagttaaatttagattttaatagtttaatttcattaaataatttaaccctgagtctgaaaattttataaactagctataatattctatagctactttatttatttatttgagacagagtctcactctgtcgcccaggctggagtgcggtggcgtgatcttggctcactgcaacctctgccttccgggttcgagtaattctcctgcctcagcctcccaagcagctgggtctacagtgagactaattacatccttcaatgaagtaccattttgtgagaaagtgagaattcaatgatttatgaaaaaatccaagaaggagaaacaaacattttctaatatgaaagtagtaatgactacagctatataaataacagtaacaaagaggtaaggaagtggcaagtaataaggtctatgagttgatttaattttggttttcatttattcctggattaagaataagcataattgacttttaatatccttgtgtttatcaaccacatagttcagcgtctgacgggtgcagagacgaatca

SEQ ID NO: 45903 - DNA, 762 bp, Homo sapiens
tagtgtgaagtcttaacttggagcccagaattcaaacttgaaactgtagaagagaggatgaagagaatattagcagttgaaaggaaaatgtagaaatagaaacattatgtatatttaacagaaaacaatgatcaacgtgaaatgttgaagatatatgttctaagtgatagctatatgtagatatggttcagagaaggcaaattgcatgtattgtttgatacacggagagaagattcgggaaaagaatacttgagatccatttgtaaggaaagaaaaggaagcaacaacataatgcccagagttggagccaattaaaccaggtttgtactttttctttccataatgtaacatgtttattctggtcttaaatctcttttattaatctcctgtcttatttcagcaaaaatctaataattttaaaccttgccatagtagtatggaggagataaaggtgaataagacatgctcttttcaaactatttgcaactaatgcaaaagaacagaaatcataacagtctctgagcccacagtgcaatcaaattagaactcaggattaagaaactcactcaaaaccgcacaaccaaatggaaactgaacagcctgctcctgaatgactactgggtaaataacgaaatgaaggcagaaataaagatgttctttgaaaccaaatggtctttgagaacaaagatacaacataccagaatctctgggacacatttaaagcagtgtatagagggaaatttatagcactagatgcccaca

SEQ ID NO: 45904 - DNA, 1088 bp, Homo sapiens
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagccagagaaaagcctcaggcttcccagagacaggtggctagattaatttttctctgggtgatggccaaagaatgtgagatagagagggaagggggtgttacaggtt

SEQ ID NO: 45905 - DNA, 484 bp, Homo sapiens
  misc_feature (466)..(466): n is a, c, g, or t
ctagctcggtccggtgttcctttgtctaaaaaccaaagttgaattcttttagaagaagggaaaaacctcttgagatgtgactgtttccatctattttctgcttgccaggaaaagaatacttgagatccatttgtaaggaaagaaaaggaagcaacaacataatgcccagagttggagccaattaaaccaggctggagtgcggtggcgtgatcttggctcactgcaacctctgccttccgggttcgagtaattctcctgcctcagcctcccaagcagctgggtctacagtgagactaattacatccttcaatgaagtaccattttgtgagaaagtgagaattcaatgatttatgaaaaaatccaagaaggagaaacaaacattttctaatatgaaagtagtaatgactacagctatataaataacagtaacaaagagtaaacattgctatcttcagaaattaaggangagagacaaagggaaaca

SEQ ID NO: 45906 - DNA, 3037 bp, Homo sapiens
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 45907 - DNA, 2309 bp, Homo sapiens
gggcgggcggcgagcggccgggagcgcgcggtggactcggccgcggcgagtagttagttagttgttgttagtcagtgtcagttgctcggcggcggcggccgtggtcaccaggaaggggacgggacggacggtgatggtggtcgccgcggcggcgtgtgcgcccctcaggtatctgcccaaactggaacttatgctgtagacatttctttgtggtttatctaaaaaccaaaggaaaagaatacttgagatccatttgtaaggaaagaaaaggaagcaacaacataatgcccagagttggagccaattaaaccaggccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 45908 - DNA, 2906 bp, Homo sapiens
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 45909 - DNA, 1100 bp, Homo sapiens
cttcaggctaaccagtgacaaaccatgttgtgaggcaggtgatgcggtttactatactgcttcatatgcaaaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 45910 - DNA, 2924 bp, Homo sapiens
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagaatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 45911 - DNA, 3197 bp, Homo sapiens
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaaaaaaaaaaaccagagacaacagaacaaaaaagaggagagtataaagaaaaccagggagaaaaagaacaccacgattttgctaaaaggcacataaggagataaaaaaaaaggcactaaaactaaaggaaaaaaacgaatttgaagaaacaagggaaacaac

SEQ ID NO: 45912 - DNA, 1598 bp, Homo sapiens
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagaatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaa

SEQ ID NO: 45913 - DNA, 1870 bp, Homo sapiens
  misc_feature (1870)..(1870): n is a, c, g, or t
catgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatcttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaagccctggcagatacaaagttcctcagtatctttttcn

SEQ ID NO: 45914 - DNA, 609 bp, Homo sapiens
ctagctcggtccggtgttcctttgtctaaaaaccaaagttgaattcttttagaagaagggaaaaacctcttgagatgtgactgtttccatctattttctgcttgccaggaaaagaatacttgagatccatttgtaaggaaagaaaaggaagcaacaacataatgcccagagttggagccaattaaaccagacagagtctcactctgtcgcccaggctggagtgcggtggcgtgatcttggctcactgcaacctctgccttccgggttcgagtaattctcctgcctcagcctcccaagcagctgggtctacagtgagactaattacatccttcaatgaagtaccattttgtgagaaagtgagaattcaatgatttatgaaaaaatccaagaaggagaaacaaacattttctaatatgaaagtagtaatgactacagctatataaataacagtaacaaagaggtaaggaagtggcaagtaataaggtctatgagttgatttaattttggttttcatttattcctggattaagaataagcataattgacttttaatatccttgtgtttatcaaccacatagttcagcgtctgacgggtgcagagacgaatca

SEQ ID NO: 45915 - DNA, 468 bp, Homo sapiens
ttacaggcatgagccactgtgcccagctggcctggttctaatttagctcatgtcatctggtgaatgtctaaaatcctggtagtttccccaggtgcttggatttggagtcccaggggatcaagaagtcaacatgtattttgaccccccatagaacatcagagatcacaggagctgttactattaagtaagtccagtgtgctctgatacagattttctccaaaaccatttttagctgtgtggccccctagctgtttgcagcaattaatatttatgagactttatttaaaaaaatatatcatttagaggtggtttgctgtgctgatttatttatgtatttatttaatcagatggagtctcgctctgtcaccaggctggagtgcagtggtgcaatctcagctcactgcaacctccgcctcccgggttcaagcagttcgcctgccttagcctccctggtagctgggattacag

SEQ ID NO: 45916 - DNA, 708 bp, Homo sapiens
cctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaaaaaaaa

SEQ ID NO: 45917 - DNA, 129 bp, Homo sapiens
gctgttttctaaacctcatgcccggtgtactcttgtgcacccaagagcgacactgctgggattttcaggacagatgctggaaaccgaaacgtacatcacttctggttgccagtctttaaaacacacagc

SEQ ID NO: 45918 - DNA, 1118 bp, Homo sapiens
aagtactgtggttatgtaggagtgtccttgtttttaaaaagtatacacttaagtatttagtactaatgggacatcacaattgcaacttagtaacaaacagttcaaaaaataatgtgaatacatagctagagagtggtatggaaaatatggcaagatgttaacaatagaagaatctaggggaaggatatacaggatcttttgaactattctacttttctgtaagtttaaaattatttcaaaatagttaacaaataagacaagtagtatttgagctgttaggaatttgtcacactgagatttttgttgtttttgagacagggtctcactctgtcacccgggctgggagtgcagtggccgcgatcattaggctcactggaagcctcaatctcaaggggatcctcctgcctcagcctcctgagtaactgggactacaggcatgagccaccacacctggcccaatttttctgatttttaatagagatgagttctcacccatgttgcccaggttggtctcaaactcctgagctcaagcaatcctcctgcctttagcctcccaaggtgctgggattacaggcgtgaaccactgtgctgggcctacactgatttttatactattagaaaaatctctacttaacggtttcattatcttaggtaaaagtattcaatagaatagctgaaataaatgtgaagcttttcttaataggcagtaattagataaaatgaacaacattctcaatcctcctcatgccacataattctctccctgcaagtttgtctcaaaaaaaaaaaaaaaaaaaaaatcacatataagaaaaaccttaagaatttgaatttggtttttccttataactgataaagaatttacacaatctctttagacatttatgttttgatatttaaatatgaaatttcaactataccatgacctatgggtgaagttggaaattatagtaaccttataacttcgtcatcatctacataatttgatactttataaaagtataattccactacttgtattttagttatagtctgatattaaatagttaatgtaaaattaaaaaatcaaccacggtagcaaatgtttgtcctgagagggtttttaaagtcctttttct

SEQ ID NO: 45919 - DNA, 2116 bp, Homo sapiens
attttttcagacatggtcccattctgccgctcaggctgaagtgcagtgtggtaatcctaactgcaggctggaattgctgggcgccagtgatcctaccacctcagcctcccgagtagctagtactacagagacactaccatgcccggttaattttttttttattttttgtagatacggggtcttactatgtggcccaggctggcctggaactcctggactcaagcaatcctcccacctgagcctcccaaaacgccgtgattacaggcataagccaccatacccaagtttaagttttaaatgtgcaaaatatttagggatatgtatctctcccatgaatgatgaaagagaagcagaaaatatttcttagtaagtgaattactgggaattaagactatgattgatacctacagcaatttaaaaagttacttcattgtacctattaatacatgcagaaaaaaatgtacttggattttatgcttgctacttcctcgctcttgagtaaattatcctttctatgcatcagtttcctcatctgaaaaataggcattctagtaatatatacctcattaggctgttctgaggaatgtgataatacacgtaaaatgcagtccctggcacactgtaaatgtctaacaaacgtttggcggctattactggcgtttcccagcccgttattattttttacatgtgagcaagttaattcagaggattacttcaagaaacaaatacttgaatacctatctgtccaagcagccggggttacagggaattcactacataaagcctctggtcttacattatatagaaaggcgatgaagagacaagaaacaggttaaacagaaaaacacgataatttcacacataaccactgccatatttaaagcactgtacaccggccctcggagccagaattctttccctcgaggttgccccaggaatccctttgacctctgccattggacgtcacagaaggcgcgactaatcgtggctggctcccggagcttcactcttccctctcttcctgcgaaacttgacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttccctt

SEQ ID NO: 45920 - DNA, 3440 bp, Homo sapiens
attttttcagacatggtcccattctgccgctcaggctgaagtgcagtgtggtaatcctaactgcaggctggaattgctgggcgccagtgatcctaccacctcagcctcccgagtagctagtactacagagacactaccatgcccggttaattttttttttattttttgtagatacggggtcttactatgtggcccaggctggcctggaactcctggactcaagcaatcctcccacctgagcctcccaaaacgccgtgattacaggcataagccaccatacccaagtttaagttttaaatgtgcaaaatatttagggatatgtatctctcccatgaatgatgaaagagaagcagaaaatatttcttagtaagtgaattactgggaattaagactatgattgatacctacagcaatttaaaaagttacttcattgtacctattaatacatgcagaaaaaaatgtacttggattttatgcttgctacttcctcgctcttgagtaaattatcctttctatgcatcagtttcctcatctgaaaaataggcattctagtaatatatacctcattaggctgttctgaggaatgtgataatacacgtaaaatgcagtccctggcacactgtaaatgtctaacaaacgtttggcggctattactggcgtttcccagcccgttattattttttacatgtgagcaagttaattcagaggattacttcaagaaacaaatacttgaatacctatctgtccaagcagccggggttacagggaattcactacataaagcctctggtcttacattatatagaaaggcgatgaagagacaagaaacaggttaaacagaaaaacacgataatttcacacataaccactgccatatttaaagcactgtacaccggccctcggagccagaattctttccctcgaggttgccccaggaatccctttgacctctgccattggacgtcacagaaggcgcgactaatcgtggctggctcccggagcttcactcttccctctcttcctgcgaaacttgacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttcccttcttccctccctcccttccttttttaaaattcttgcctgtcttgccctgattaggaaagaatatcttttaaaaccaatggcttagtatatgtcatttatattgaccctactgaaattattagctacaaatgtgctataaagcatccattgaattggccaggcgcagtggctcacgcctataatcccagcactttgagagactgaggtgggcagatcacctgaggtcaggagtttgagaccagcctgaccaacatggagaaaccccgtctctactaaaaaatacaaaattagctgggcatagtggtgcatgcctgtaatcccagctattcaggaggctgagacaggagaatcgcttgaacctgagaggcggaggttgcggggagccaagatcgcaccattgcactccagcctgggcaacaagagcgaaactccatctcaaaaaaaaaaaagcattcagtgaattttcggagttactctcattagccttgttcagagtctttgggggaaatttgagatttttgagattttttttaaaaactcaaatattttactagtttgcctgccattttatttcttttacaaagcagaagcatataccaatttatcacagtattttagtaaatactgcaacattcatccttaaatgttcaccaagaaaagcatctttgtagtagtgctggaaaactattcagaatatacagataaaaatgctgttctttaattgcttacattgcttcttcccataaaaagcaaaaaggaatcagtgcttgctattgctcctttccttgaagttgtaacaattgatacatatattatgagttgactggtcgattctgtacctggcccatcctttagaatgttcttgtcatgtagcagtcctacgtactcttttcatgagcagtctgtgatctcactctgtgagttcagctattactcgctcgtgggagcttaatcttttcaaaatgaagttgatttaaaaagtcttcaggcagagtaatcatgttagaggtggtattcgatggaagaaagtttagagagttaggagtgggggtagaattctagaatttataagagtccaggaagcatagcagtcaggggcaaaaattagcgtaatatggagtaggcaatagaggagctactggagtcagaagtcactgcagagtgcaacataggaagatggactcctagcttacatgagattccctgcagctgtaatatagacaattcccacatggctgttctacacagaattacctgctaagattttttgtttatttttgtttgagtggtattttcactccaattgtataatggaaatcagtggg

SEQ ID NO: 45921 - DNA, 1990 bp, Homo sapiens
attttttcagacatggtcccattctgccgctcaggctgaagtgcagtgtggtaatcctaactgcaggctggaattgctgggcgccagtgatcctaccacctcagcctcccgagtagctagtactacagagacactaccatgcccggttaattttttttttattttttgtagatacggggtcttactatgtggcccaggctggcctggaactcctggactcaagcaatcctcccacctgagcctcccaaaacgccgtgattacaggcataagccaccatacccaagtttaagttttaaatgtgcaaaatatttagggatatgtatctctcccatgaatgatgaaagagaagcagaaaatatttcttagtaagtgaattactgggaattaagactatgattgatacctacagcaatttaaaaagttacttcattgtacctattaatacatgcagaaaaaaatgtacttggattttatgcttgctacttcctcgctcttgagtaaattatcctttctatgcatcagtttcctcatctgaaaaataggcattctagtaatatatacctcattaggctgttctgaggaatgtgataatacacgtaaaatgcagtccctggcacactgtaaatgtctaacaaacgtttggcggctattactggcgtttcccagcccgttattattttttacatgtgagcaagttaattcagaggattacttcaagaaacaaatacttgaatacctatctgtccaagcagccggggttacagggaattcactacataaagcctctggtcttacattatatagaaaggcgatgaagagacaagaaacaggttaaacagaaaaacacgataatttcacacataaccactgccatatttaaagcactgtacaccggccctcggagccagaattctttccctcgaggttgccccaggaatccctttgacctctgccattggacgtcacagaaggcgcgactaatcgtggctggctcccggagcttcactcttccctctcttcctgcgaaacttgacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttccctt

SEQ ID NO: 45922 - DNA, 3382 bp, Homo sapiens
attttttcagacatggtcccattctgccgctcaggctgaagtgcagtgtggtaatcctaactgcaggctggaattgctgggcgccagtgatcctaccacctcagcctcccgagtagctagtactacagagacactaccatgcccggttaattttttttttattttttgtagatacggggtcttactatgtggcccaggctggcctggaactcctggactcaagcaatcctcccacctgagcctcccaaaacgccgtgattacaggcataagccaccatacccaagtttaagttttaaatgtgcaaaatatttagggatatgtatctctcccatgaatgatgaaagagaagcagaaaatatttcttagtaagtgaattactgggaattaagactatgattgatacctacagcaatttaaaaagttacttcattgtacctattaatacatgcagaaaaaaatgtacttggattttatgcttgctacttcctcgctcttgagtaaattatcctttctatgcatcagtttcctcatctgaaaaataggcattctagtaatatatacctcattaggctgttctgaggaatgtgataatacacgtaaaatgcagtccctggcacactgtaaatgtctaacaaacgtttggcggctattactggcgtttcccagcccgttattattttttacatgtgagcaagttaattcagaggattacttcaagaaacaaatacttgaatacctatctgtccaagcagccggggttacagggaattcactacataaagcctctggtcttacattatatagaaaggcgatgaagagacaagaaacaggttaaacagaaaaacacgataatttcacacataaccactgccatatttaaagcactgtacaccggccctcggagccagaattctttccctcgaggttgccccaggaatccctttgacctctgccattggacgtcacagaaggcgcgactaatcgtggctggctcccggagcttcactcttccctctcttcctgcgaaacttgacacgccatttgtttctacgtctgacatcctcctcttttctctggtccgtgggagcttttgcaagcgggaccaggccccaacacccgaaccagcagcgagagaaggagcccggcatgcggcgactcagagtgacgacacacgcgagtctccgcccgagtacgtcacttccgcaacgcttccttcgcggggctttgtgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacagtcttactgacctttatgtccaacatgcaataccattgcctcagagggatttgccgaagaatagatgggggaaaatgatggaaaagaaaagagaacaacatgagattaaaaatgagactaaaaggagtagcactgtagatgggttaaggaaaagacccctcatcgtatttgatggaagttcaacaagtacaagcataaaagtgaaaaagacagagaatggagataatgatcgactgaagcctcccccgcaggcaagctttaccagtaatgcctttagaaaattatcaaattcctcttcgagtgtttcacccctaattttgtcttccaatttgcctgtgaacaataaaacggaacacaataataatgacgctaaacagaaccatgacttaacgcataggaaaagtccttcaggccctgtgaagtcgccaccattgtcccctgttggaactactccagtgaagttaaagagagctgctcctaaagaagaggcagaggccatgaataacctgaagcccccacaagcaaaaaggaagatacaacatgttacttggccctgaagaaaagtttccaaaaatgtaaatatactgtaactgtagtttttcaaatatgttcatatatattgacaatatttacagaaatcctgattattgtggaattttcttaagaggtttcaaataggtttaaaaaaataaaggatttattttccttcccttcttccctccctcccttccttttttaaaattcttgcctgtcttgccctgattaggaaagaatatcttttaaaaccaatggcttagtatatgtcatttatattgaccctactgaaattattagctacaaatgtgctataaagcatccattgaattggccaggcgcagtggctcacgcctataatcccagcactttgagagactgaggtgggcagatcacctgaggtcaggagtttgagaccagcctgaccaacatggagaaaccccgtctctactaaaaaatacaaaattagctgggcatagtggtgcatgcctgtaatcccagctattcaggaggctgagacaggagaatcgcttgaacctgagaggcggaggttgcggggagccaagatcgcaccattgcactccagcctgggcaacaagagcgaaactccatctcaaaaaaaaaaaagcattcagtgaattttcggagttactctcattagccttgttcagagtctttgggggaaatttgagatttttgagattttttttaaaaactcaaatattttactagtttgcctgccattttatttcttttacaaagcagaagcatataccaatttatcacagtattttagtaaatactgcaacattcatccttaaatgttcaccaagaaaagcatctttgtagtagtgctggaaaactattcagaatatacagataaaaatgctgttctttaattgcttacattgcttcttcccataaaaaatatattatgagttgactggtcgattctgtacctggcccatcctttagaatgttcttgtcatgtagcagtcctacgtactcttttcatgagcagtctgtgatctcactctgtgagttcagctattactcgctcgtgggagcttaatcttttcaaaatgaagttgatttaaaaagtcttcaggcagagtaatcatgttagaggtggtattcgatggaagaaagtttagagagttaggagtgggggtagaattctagaatttataagagtccaggaagcatagcagtcaggggcaaaaattagcgtaatatggagtaggcaatagaggagctactggagtcagaagtcactgcagagtgcaacataggaagatggactcctagcttacatgagattccctgcagctgtaatatagacaattcccacatggctgttctacacagaattacctgctaagattttttgtttatttttgtttgagtggtattttcactccaattgtataatggaaatcagtggg

SEQ ID NO: 45923 - DNA, 845 bp, Homo sapiens
ccaatagacatgaaattcaactgaatgttgatgtgccttttgaaatcatagtgtggttctaaaaacatgtgtttgcctgccatcctttacattatgacattctgatttgccttttccctccttaaatgatggcagcgaagggcacatttaagggtcccattcagcacaggagatctcatacagagtcatggagaaacctcactgagcaccagcatacaggccgacgcccagggcaccttagattagagtcaaggccaaacaacagttccagtggccgcggccaccttgctgcatcctggagctcccacctgcaacttaacccgcggggtctcatttacgccagcgacctcacactcacgctgctactcgaagctgaacagccctttaaaaacctttagagaaatttgggaaactcagatgttttccacctggactttgttagcagcgtctctgccgagtgccctgggtcagaacatgcccaggaaaatcagctcccagcaggaaataaattaaataagggtgtcattggacccacctgacccagggtcagttcccattaaaaagaaagtgtgctggcctggtgtgttaatgcttccttcgctaaaattttaagttatttttagttttagctcataatatttttctccctggggaaaaactttatttttttccctcagcgagtttgaacactcatctaaactgagtgaagtttttagagcctaaataattacacaaaagacaaacttctataaatgttttatttagagccaaaataaaaacacagaagaaaaaggatctgaatcatttattctaacaagtcttaaataactgtttcttctttccca

SEQ ID NO: 45924 - DNA, 440 bp, Homo sapiens
gctgtagtgagacgtgactgcactgcagtctgggcaacagaccaagaccctgtctcaatcaatcaatccaatcaatactaaagtcaaaattataggaaatgaccctttatttacaagggaagttgtcatcaccctaaacattgattcaacaacttgattttataaagttttactgggtgccagatgtatttacaagcaaaagcaatgggaatggtgtagtcagttagtgagggcctcttttccatcatgtgtaaccaacttctaaggttttcagctccaccatgattctttctcatgaagctatcaagcacagcctgttttcaattatttttgctttttgtccttcatttaaagtagactaatgcaaaatatgctatcttaatatcatgctgtttctaaataagcaataaaatattttctgtgatcggaaaaaaaaaaaa

SEQ ID NO: 45925 - DNA, 354 bp, Homo sapiens
aaaacaaaggtctgccctccaaataaaactattttaccagagccttatctgacttgagagagaagcagccttcctcgctggcctctggaaagaaaaataggtggcagggagaggggatggctaagaaatacttccaaaggtcacatcccagaaattcagactaaaaaaaaaaaatcagatttaattttaagattacagaacatttccccttcctctctccaacaccttacttccatatcaacatagctccagtgtaacaaatgcagattacaactaaaagagctgcaggacacagaatctattcaaagaagtagttcttggggaaaaccaaagaaagaggagtttaaaataaaa

SEQ ID NO: 45926 - DNA, 4452 bp, Homo sapiens
  misc_feature (1429)..(1429): n is a, c, g, or t
  misc_feature (1654)..(1654): n is a, c, g, or t
  misc_feature (1668)..(1668): n is a, c, g, or t
  misc_feature (1687)..(1687): n is a, c, g, or t
gtacccggtgtttatcgatgccacaccatcccccctcgggaaatggaaggaatgtctaaggaggaggagggctgtgtgtggcttggaatgtttttgtgaaagcatttgttgaccatgataatgcaaataacagaaggagagagagaatgaaccctttctgggtgtttcagggcaagctttacgttcctttgtaggaaggggagtaataatgtaaaacaactgacccagagaagctaaaagccactggcagcacaggctgacaaaatggaagcaaagcaagaggtggcaacaattttgaaagaccaaaagttgtgagtaactttccagtttgatagtttataaagaagttaagtaaatgtagtattggctagttactgtaagtcctcatcttctggtaggtcctgtaactctaattaggcatttgtacatttttagcagcaaaattgcctcagcagagctcccagttttattcccagttgtggctgaaaagcaaagccatggcatcagtatccttgtgcaatcggaggttgctgggctttcaccacctgtgttgttaaccttatttcctggaggaagaaacagatgaaacaagtgcctaactccctttatcaaacacagccaaggacagcctcttttaacatgtgacttcatacttgaggaaaaggagagttgacagctgtatttaaaaacccatggagccgggtgcggtggctcacgcctatgatcccagcactttgggaggccgaggcaggcggatcacaaggtcaggagattgagaccctcctggctaacaccgtgaaaccccgtctctactaaaaatacaaaaaattagccgggcgtggtggcgggtgcctgtacaggaggctgaggcaggagaatggcgtgaacccgcgaggcggagcttgcagtaagctgagatcgcgccactgccctccagcctgggcaacagagcaagactccatctcaaaaaataaatagataaaataaaaacccatggaaatggtttaagaaaatggttctgggtacaccagaaatttgtttgcctgaagctaaagtgtgtctacaatggtacagctcttccagggacatgggaagtttatcgtgggagatatccagaacctgttttacactgggctcctactgtgtttggtgatcagaaactatagaggggtccaacccaggatttcatgtttgtatcttcataaggccatgctcctgacaggtctaggcaacctgggggatgacttaggttagtgtgctaggattgacacacctcatccagccttcttactttgtggatgggaacacttaaggaatagagagattaaatcttacacttaccccacagctggttactgacaacacaagctctagaattcatgtttgtttgtttgttttatttcaccaggctgcatgagactgaccttcnggcattcttactaatagtctttctattatactattggatctttattcatccacctatacaagtaggaaataaggatgaatattcatttagaagaattaatattcatattaacacattgctctcagattattgggaattaacatcttgtaaaaactgggagcaggccaggtacggtggctaacgcctgtaatcctgacactttgggagtctgaggcgggtggttcntctgaggtcagtcnggagttcaagaccagactngccaacatggtgaaaccccgtctctactaaaaaaaaaaaatagacaaaaattagcgggggggtggtggcagggcctgtaattccagctactcaggaggctgaagcaggagaatcgtttaaacacaggaggtggaggttgcagtgagccgagattgtgccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgataaaaaaat

SEQ ID NO: 45927 - DNA, 2664 bp, Homo sapiens
tttttattatttatttatttatttatttatttagagacagagtctggctctgtcacccactgcactccaacctgggtgacaagagcgagactccgtctcaaaaaaaaaaaaagaaaaaaactgcagccaaagttggatttgcggcctatgaataaaaccattactttaaaaagtaatacccccaaaaaagttacacctgaagtttcatcttcatgcctttgtgtaatattactataatggtgaaatgatgatttaaaaaaaacacatcagaactgacacatcctcttggatgatgggtccttcagtcaccttgtgagcccatgtacttattccgttgatacagcctgtgctataaacatgtggggccctccttgtgtgagctgcttgaatggccagtacccccattcttttgaatattcccaatggcagtcaatcttggcctttaagaataaatttaaatatttggaaatagtccttaggatccaagtttgatcaatgaaaaggatgcttaagctgagtttggggtcacataagaagtgcagttataaagaaataagacatgttgggcatggcagtacacacctgtagtcccagctgcttgggaagccaaggcaggaggatcacttcaacccaggagtttgagtccagcctgggtaacatagggaaaccccatctcaaaaaaacaaaacaaaggacttagtttttatgtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgataaaaaaat

SEQ ID NO: 45928 - DNA, 1739 bp, Homo sapiens
gacgggtgatctagaggatcccagcggggaacactcacttatagctaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgataaaaaaat

SEQ ID NO: 45929 - DNA, 276 bp, Homo sapiens
aactgtctcaacactcttactactacaatagttttaagtaaagcttttttaagtgcctctgatattttctaaattctaatattataaatattttttcgatcaaacaatatacaccttgtagtattcaataaaactgatatatttgaaaataaacttatgtcaatgaatttcgactaaaaactggggtgcagggtttaaaactgtcctgacaactcattttgatgcatggttaattctaccctatgtctccacttccttaaatagaagactacaaac

SEQ ID NO: 45930 - DNA, 375 bp, Homo sapiens
aggtaggacaaacactgaggtgtaatctatgctccagggtcccccaggggatcaggctgaggttgggacattgcctaaaatcccacccttgcttggtttcttctctttccctgtttttccttcttctctcactctctcatttctgttccttcttccttaaataaatctcctgcacacaaattctcatctcaaggtgtgcctctgggcagcctgatgtgagatacagatgtgtgtttgacctcagcctgccctttctggagtcctgcagcctcgccccttgttttgtggggttatcagatctcgctacgtagactcggggtacggaatacatccagcttggaatttctgggtgctcgcaagttctcagtagaacgc

SEQ ID NO: 45931 - DNA, 415 bp, Homo sapiens
tataatagtaatgcatagtaatgcttttaaatgggcatatgtgtttataatcattttgacatcttagatttcaatttaaggtaaaatgggcaagaaacaaaaaacaaaaattcttatgtccaagtgctctgcatctctggaaaagaagttcttttttattttcccagggttattattataatgctaatttacttttttagttttttgtttctccctgcatccgatagtgctataatttttttttttttttgagatggaatcttgctctgtcactcaagctggaatgtagtagcacaattttggctcacttcaacctccacctcccaggttcaagtgattctcctgcttcagcctccctagtagctgggattacatgcgtgcaccaccatgcctggctaatttttgcatttttagt

SEQ ID NO: 45932 - DNA, 619 bp, Homo sapiens
ttttgctctcatccctggaggtgtaacagccttttcccattcagtactttatttttccagatagttcatatggagtagaaggaacatactatatctgtttctgtactgatggatcgtgttcagttgtgtacatttatctctgaggcctgctaatgccatctgagtttctaaaatccttatttttgcaaatccatttgtgtcctggggtttagctcctgattttagggattagcacagattacagggtctgtctgatgccttctccaagctttgtatcagatttatgggctatggaattgaggaagcttgcacataggataggcgtgggaaactagaggcagatacgagctgatgggagaaaaaagcaaaaggagctcttgtaaagaattggagtagttatcaggccagatatttggatcagaaccagttaagaacctgaaaacgccaactttctgtttcttgacttcacaactgtgctgggctgcctgttccctcttttccagaacagttttccatggaccctggctgtgcctcctccccaccccacccagtggctgcccccagaatagagttctaagccatgctccagccctctgggtggcatcctttgctaagaggg

SEQ ID NO: 45933 - DNA, 505 bp, Homo sapiens
aatcagtgggatctctccctgaggagaattttgtcatcagaaataaaagtgacaacaccaagaggggaagtgttataaataaagtgagtagtgtttggtaatcatcaccattcttgatttcctatgtggaaataggactttgatatatgcattttttaaagcatcttgcaatttaaaaaattacacatggaacaagccaaataaatatttttaaaatactgtttttatttagagagagagacagctgtataaactgctctgtgtatgtgtaaaacattgataatacattagacataatttgcagaaactactaattttcacatcatttccaagtagaactgcaaaggtacagtactggtttagctttatggttaaaagcattggctctagagccagataacacaggctcaaaccctagttctgccgtttactggttgtgttaccttgggtaggttacttgacctttttgagcttcagatttctaatctttatttaatgagtttta

SEQ ID NO: 45934 - DNA, 354 bp, Homo sapiens
gccacctaatatgaaaaatctaatctcaccctaataaaaatcttagacctggcaaaaaaagaaacatatagctttgtggtaacgtgaggagaggagggaggtaacagaaatggtagaatgacctcacagggttttgacttttaaacactaatatttatagattaaaaactgtctgaaaggttaagcttggaaagaatctacttcagatacctgatacagcacaggcacaaaatgaaccatgtttgatctaacttgtaccaagggagaattttacctttagctttaccaacttcccaagaggacttctagtcatgctccttcaaatcccaaaggcctgcgtagtgaggtatgcca

SEQ ID NO: 45935 - DNA, 459 bp, Homo sapiens
tgctcttactttcactgtggtccccgtgggctttttcaaggctctgtcctggcccagggaaaggtggaccatgagacctcacagccagaaagaagcagcagccaactgagtttccgaatggatttgaagagctcacagcagaggagataccagtttgaaaatcaagatgtgtttgatttgctttggccatcaagagacacatcctgaaggactctgtctcaacatttttctacataaaaaaagagtggggaagaatgcaggttggtgggagctgggagataaggtccacaggccaggagagggcccccaggctgggtcgtgtgaggcagtgtccatctgagaaggaaagtctgctggctgcagggtcccagcacccaggagctagaggagagggggtgggagggagagcagctacgtgtccctgggtttcttgagcgaggactgataaaccccaggggc

SEQ ID NO: 45936 - DNA, 405 bp, Homo sapiens
tggaagcagctgagttaaaggtttgtttggctcagtcttgtcttttctaatgtaaactggagttatgctgagaagctcctgacaatctttctcatgtacaacaggactagattctaaaatcagctgcatctgttcaagttcatgtgcacctgcaaaaaggattttaccagtcagcatttcgaaaagatgcagcctgcagcccacatgtcaatggctttagtataattattatgagaaagtaaatgatgtggagatctgtatcatttagtaatcaatccttcagaaagatgatgcttatgggaataatgaggatccatgatccgtgcaagactaaagtcacctatcttcagcaccaagttttcagtattaatgaaaagaatagctggtttgggatctctgtgcagt

SEQ ID NO: 45937 - DNA, 396 bp, Homo sapiens
atcagtaggcagaaatggttggaatttcctggtcccagtttcagatcatatctgtctttccccagactcctaacttcctgttgggacatcccttggtctggcctttccctccagagaagcccccagacccacccgcagccttgatttactgatgcctaatcttattttagtctttcacaccagtttttaacaactcgactgtatagatcttctggaaattttacccaaaaatgttagatgtgccatcccctcacaggggaaagtggtggggtggtgggggttaatgtgttgaaaatctatgtatcttgtattttatttgagtcagctgtgttttcacaacaactctgagagttaacatcatttctactttataaattaaaaaaacaaaacaaaaac

SEQ ID NO: 45938 - DNA, 310 bp, Homo sapiens
acacggtgaaaccccgtctctactaaaaatacaaaaaaaaaaaaaaaaaaaaagtattttgtgggtgagaataaaataaataatggtttttaaaagtctctatttttttcacagaataggtcttcagtaaatattagttgttttgttgtaattattgttaataatgtgtgacaggaactaggcaggtttatatggaaaaagtagaagtagtgaccattcaggatttttacatgagagctgggctattcaaagttgtcagttgataaatgagtctgaaatttaggcaaaatttttaaatgtgatgtgaaag

SEQ ID NO: 45939 - DNA, 695 bp, Homo sapiens
tggaagttagttctgccacgttctgtttgttcccagaaaatcactaagtctggcctacattcagtaagagaggaattaagtttcaccttttttttttgaaggcaggatctttcactgtcgtccagtggagtgcatatggctaacttcagcctcaacctcctgggcttcagtgatcctcctgcttcagcttcccgagtagctgggactacaggtgtgcgtcaccatgcccagctaatttttaaattttttgtagagatgggggtctcaccaacttgcccaggcttgtctcaaactcctaagctcaagcagtcttcccacagtgttcccaaagtgctgagattataggcgtgaaccactgtgcccagcccactttcactttttaaagagagaaatgtcaaaacatttgcagacatatttttatttttaaatcgccacacctgacaccactcaatcattgttgaagtctcaaaaattagtactaataaactaacttgttaatgtcacatatgcaatagtgcttttagccatggcacatgccttacctgtcatcactgccacataactccctgtgtgtcattggccaagatatttatcatctatgggaattatttgcaaagtataatcaagagcctacatgaaacccaggcatggtggcgcacacctgtagtcccagctactcgggagactgaggcggg

SEQ ID NO: 45940 - DNA, 408 bp, Homo sapiens
ctccattattcaaagcacttagtggactataaatgatttagaagtgatacaactagacttttcagagtaaatagttttcattttcctgattggtaatcaggagaaagaagattccatattcccatcagcagagatttagaattatcttttgccaaaaatgaaagagctctttcttcctgtgtagtccttttaaatatacatatatatgaaggtgaatcaaaagaaaaagaaaacagattacaactttattactgcccttgttggacacttataccagcaggctagcagacactgcacagaatatagaaatgagactctgagtacatgatctataatgaaaatgaagccaatcagaatctaatattactacaaggttgaaataaaagctatggtatttctcataactgc

SEQ ID NO: 45941 - DNA, 297 bp, Homo sapiens
acgttggtcaggttggtcttgaactcccaacctcaggtgatcggctcacctcagcctcccaaagtgctgggattacaggcgtaagccaccacgcctggtctacctgtcttagtctcagcactcacctgttcacatgccactagttcagaaagtctttgaggtcattctttcaatagacactggcttgtagattgctgtgttctttttcttcttgggaataaggttagaaaaatgtgctagggaaggatgtgctacacaaaaatgtgtggaaaaatgtgagagcggccgggtgcagtg

SEQ ID NO: 45942 - DNA, 358 bp, Homo sapiens
agaaaaaaaaaaagagtaggtctacagccaatacctccttggtaaatgcaagggactgttgagtaaaatctctgcggcacatcctcagcactcttaatgtgtctaacctctgctgacagtactgctatcaaaaaaaattaccaaattgatcaccctgaagaatttaaactaagatcactgatatagtttggatgttgtccccacttatatctcatgtcaaaatgtaatcccagtgttggaagcagggcctggtgggagtgattggatcatgggtgtgaatttctcagcaccatccccttggtgctgttccagcgacagtgagttctctcaaggtgtggttgtttaaaagtgtgtatca

SEQ ID NO: 45943 - DNA, 337 bp, Homo sapiens
cacgaggggcagaacccggactaagtctgccctttcctctctgcatagttaccatctaataggctgggtgcccagaggggccccttcttgcctagggaccagtctgcctttgtaggactaacaaattagctacaagattagaaattacagtttaggggtcatgtcgcctatggctccaagagtctgaacctccccaaattgttcctgggaataacatcactattgtaaaacctaagatcagtgcttgagatattttgcagaccctgcactcgatggatcagctgacaccaccaagaccagtaatctggcttcaccagttctgccatcccacccagga

SEQ ID NO: 45944 - DNA, 421 bp, Homo sapiens
tgcaagaccaccagagtggtgcccccagaaccctggcctgtgtgccgtgaactcagtcagcctgcgtgggagatgccaggcctgtcctgcccatcgctgcctgggtcccatggccttggaaatggggccagggcaggcccaagggaatgcacagggctgcacagagtgactttgggacagcagccccggactcttgccatcatcacatgagccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgt

SEQ ID NO: 45945 - DNA, 361 bp, Homo sapiens
tggcaggacaccagccacacatggcggattcctggccccggagctccgcacaggaagcaccagagctgaaccgacagtgctgggtcttggggcactgggtgtgaccaagacctcaacctggcccgcggacctcaggccatcgctggcaccaccctgctgggcacagctgcgatgccaggagacacatggccactggccactgaatggctggcacccacaagccagtcaggtgcccagaggggcagagccctttggggggcagagagtggcttcctgaaggagggggcagtggcgcaggcactgcaggggtgtcacacagcaggcacacagcaggggctcaataaatgcttgttgaacttgt

SEQ ID NO: 45946 - DNA, 271 bp, Homo sapiens
tatatcaaaatgctgaactacactcaatgacaactgactgcggaggtggcaaagtgttcactgtcataaaatgacaactcagccagatgattgatttctccacctattgcctgaaacttatttttaagaaaattcatgaaaaagcaccaagactagaatttaaacaaagtgataataaatgtatacttatgttgcaaaataaaattcaaactgccccacaggcagctgtgagcccctcagtatcataaatccacataaactctacacttca

SEQ ID NO: 45947 - DNA, 315 bp, Homo sapiens
ttgagactagagtttatcaagaattttggtgggctgtggtgttttacacctgtaatctcaacactttggcagctggggtaggagaatcatttgagaccaggaatttgagaccagcctgggcaacaaagggagacccccatctccacaaaaaattatgaaaaaaaatgttagctgggcatggtggcatgtgcctgtagttgcagctactcagcaggctgaggtgagaggatctcttgaacctaggaggttgaggctacaatgagccatgatcgcgccactgcactccagcctggctgacagtgagaccctgtctca

SEQ ID NO: 45948 - DNA, 847 bp, Homo sapiens
tctgaaataacctttttctccccagttaatttctacaagcctttcctaactcaacacatactacagtgcacttttcattcgacctagcagtatttattggggacctgctatgtgtcaggcactgttctgggggttgagattaagagaacaagatcgatcaagtccttctctcctggacgtttgattttagttgagagagacaagataataagcaaagaagaaaaatatcaaatagtgagacgtgctatataaaaagttaaaatagggtaatataggagtgacttgatactttagatagagtgatcagggaaatatctgataacaatcaaaatctgaatgacaaaaacagctgcattcactgcgtgatgattgtatgttaggtattgtttgaagtgctttacatgtgttagctcacttgatcctcagaacagccttttgcagttgttaccattatcctcatttgacaaagaagaaaactggggcactagagcccatgttctgaaccacatgctaaactgcctgccttatgaaaagacagtgaaaatgagaaaagagaattcagagtagagagaacaaccactgcaagtcccctaaggctggttggagcttggcgtgttaaaaaaaaagaatgccagtttggctgcaccctggagggcaaaggagagcatgggaagggaggtgacagagggaggcaggttccagatcacacaggacttgagtgagcagggaaattagtttagattttattctaagtgctatagtaaaccagttttggggttactgttctgtgacatggtttaggggctgccatgtttggtctccatcatactgttgcaattagatggca

SEQ ID NO: 45949 - DNA, 463 bp, Homo sapiens
ttttagttttaaaaattacattttgccatggtgaaagcagtggataaatgacagagaaacagatatataagcatgcacacttccaggagacaggtgctcaaaatggtcttatttaacatttttataaatgatgtcagggaaggggtatacaggaaagtaggcaagtttgtattaagctcttctagttaccaaaatgccatgtaacagagataaaacatccttttagcagcaatctgataaatatggtagaatccttttaaccaacttccgcttaaccaactgtccagattaaccaatgagctccattccccttgtaaatcatactgactgatgcacctggaatgtgaccagacagctggctcctctctgagcagaccgagtacctcagctcccatcagccaaggcacatttttaataagaggtttttatcctaaacttgtttatgcagtaatgccttattttt

SEQ ID NO: 45950 - DNA, 421 bp, Homo sapiens
caacatggtgaaaccctgtctctactaaaaatacaaaaattagctgggcgtagtggcaggtgcctgtaatcccagctactcaggaggctgaggcagaagaatcgcttgaacacaggagatagaggttgtggtgagccgagatcgcaccactgcactccagcctgggcgacacagcaagactctgtctcaaaaaaaaaaaaagatataaaccagtaaaatgcagccagatatatgcttgcctggattagacgtataagagatttgggtgtaaaaatactgtgtgtggccaggcacggtggtgggcgcgtatagtcccagctacttgggaggctgaggcaggagaatggtgagaaccagagaggcggagcctagatcacaccactgcactccagcctgggagacaaagcaagactccgtctca

SEQ ID NO: 45951 - DNA, 3662 bp, Homo sapiens
ggcacgaggattttactgctgtctcaagatcagattattactgtagagaagatttttattttttgtttcattaacagattattataaagcaaaaagcatgcagaaaaagaagcagacgttttacattgggaattaatgaaagcgtgtctgctagttttgggtaggagaactgggaagttgttgcttaaaattttatatcacctccacaaacaaaactcttcggaaatggtaaaataagaaaatgcatgattctagaggcattcctaagcacccacgtgtcaggctttgtggtgtctgtggtatcatccgaccgtttggactggttagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggctctacctggacttatgggactctgacttgcaaagtgattgcctttctgggggttttgtcctgtttccacactgctttcatgctcttctgcatcagtgtcaccagatacttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaatttacccgtgtagcctgttaattttcttgaaataagttttacatttttggcacataacaacgttttttttaatttgggaggcaagcacaaactaggaagactagctttattatggttttgctttttgattcttgtagctactatattccagactggaaatgtatgaatgataatcaacataatgctgataaactgacataatattatctgtaaaagcattatttggtagtttattataatcatccctctattattcttaaatgccagtagtatttagagatgtgtacctgcttagttaattggctcagaattttaatataaacatcacactttaatttggagcatagtaccatagaaatttggggttctaaatatacaacttgtaagaagaatggtttacactaacattatgacaaaactagaaaaagttattatttttgtttgctttctgttgttttgtttattggttggtttttgtgaagtttattttttttttggtatttgataattaagattaggaatctaataacacagaattccatattgctatagtacttctgtaaagagaatatcaatataaataaggaaaataaatcaatgaaatgtttcaatg

SEQ ID NO: 45952 - DNA, 3220 bp, Homo sapiens
ctgcctttgggaagaggatgggcctgaggtcctgaaagggcctttccagccccccactacaaatgcggggagggaaaagttcagaagcagccacgaagggacaaaagcttaatgctgccagttggattggacagggcagtcaataaacccagccagctctggagtcaggtaggggttcctgctggttccacagaggctgaagcagccccgccgccgccctcgccaccgcagccgccgccgccgcggcccctgcgttactgggggagacggtgccgctgcgacaggggaggacgcggctggagctcaaggaggctccagcgcgcaggcgccgccgagccctgcctggatgctcagtcaaggcactaaggcaaaaaaaaaaaaaaaaaaaacaaaaaacaaaaaaaaaaaaaaaaaaaagaaaaagaaaaaaagaaaaaaatcagcaatttatagaaagaagctatagtctgtcgggatatccaacaccaacagtagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggctctacctggacttatgggactctgacttgcaaagtgattgcctttctgggggttttgtcctgtttccacactgctttcatgctcttctgcatcagtgtcaccagatacttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaattt

SEQ ID NO: 45953 - DNA, 4346 bp, Homo sapiens
ggcacgaggattttactgctgtctcaagatcagattattactgtagagaagatttttattttttgtttcattaacagattattataaagcaaaaagcatgcagaaaaagaagcagacgttttacattgggaattaatgaaagcgtgtctgctagttttgggtaggagaactgggaagttgttgcttaaaattttatatcacctccacaaacaaaactcttcggaaatggtaaaataagaaaatgcatgattctagaggcattcctaagcacccacgtgtcaggctttgtggtgtctgtggtatcatccgaccgtttggactggttagggcttactgagagctccatttctggaaagccttacaagactgaggaatatcagactgcgaatcaccgggaacggttcctttgcagcacagaagcaatctctctccccatcttcgcatattctgatggcaaaacaagtggaagaaaagaggaagcatgactgcagatcagatcagttctctttgtggattatattttcagtaaaatgtatggatctatcttttccttgttcttatatctagatcatgagacttgactgaggctgtatccttatcctccatccatctatggcgaactatagccatgcagctgacaacattttgcaaaatctctcgcctctaacagcctttctgaaactgacttccttgggtttcataataggagtcagcgtggtgggcaacctcctgatctccattttgctagtgaaagataagaccttgcatagagcaccttactacttcctgttggatctttgctgttcagatatcctcagatctgcaatttgtttcccatttgtgttcaactctgtcaaaaatggctctacctggacttatgggactctgacttgcaaagtgattgcctttctgggggttttgtcctgtttccacactgctttcatgctcttctgcatcagtgtcaccagatacttagctatcgcccatcaccgcttctatacaaagaggctgaccttttggacgtgtctggctgtgatctgtatggtgtggactctgtctgtggccatggcatttcccccggttttagacgtgggcacttactcattcattagggaggaagatcaatgcaccttccaacaccgctccttcagggctaatgattccttaggatttatgctgcttcttgctctcatcctcctagccacacagcttgtctacctcaagctgatatttttcgtccacgatcgaagaaaaatgaagccagtccagtttgtagcagcagtcagccagaactggacttttcatggtcctggagccagtggccaggcagctgccaattggctagcaggatttggaaggggtcccacaccacccaccttgctgggcatcaggcaaaatgcaaacaccacaggcagaagaaggctattggtcttagacgagttcaaaatggagaaaagaatcagcagaatgttctatataatgacttttctgtttctaaccttgtggggcccctacctggtggcctgttattggagagtttttgcaagagggcctgtagtaccagggggatttctaacagctgctgtctggatgagttttgcccaagcaggaatcaatccttttgtctgcattttctcaaacagggagctgaggcgctgtttcagcacaacccttctttactgcagaaaatccaggttaccaagggaaccttactgtgttatatgagggagcatctgtaaatctttagccttgtgaaaactaaccttctctgctgagcaattgtggcccatagccatattttgagaagaaattcaagaatggaatcagcagttttaaggatttgggcaacattctgcagtctttgcaatagttcacctataatcctattttaaatctcagagtgatcctgctgactgccagcaaaggtttgtaattaagaagggactgaaccactgccctaagtttctttatgtggtcaaaaactagataatgaaagtagcaggtgctaagtatcagtgctaaatgctctgtatgtcactacatatgaaaaaacatcaaaaaacaattagcattggacatcttaataaattaagttgacatgaggtaaatgtgttgataaaaactaattttagaagtttgaagactttaaaacatttcatactactattgttttgcaaagactaaaatatttggggacttaaagtactgtaatccactaaagacgtgccaatgaattattggaatatcacactttaaaaaccgccttgtaagttctggggagcattccaaagcagtatattggttccaattagagtttactttttttgtattaatacattgctatttctaaataccactttcctcatctactagtaagattgctagcattgaactgtattatgtggtttttgttgatttggtataaagtttttccaattcatttatattttacaaatgctagatattggtctgggaggcaacattaatggtaccagcctgtcacaactgagcagttctaataatgcagaataaatacatgttgccttaaagggttatctagtatccttcatcttatttagcactggagcaaatagccaagggaaatcaaatcagtaactggtcatggtcatgcatctaaaagtgcatggaagatcatttattactttttccttttttctcacatggtttgaaacttaaagtgcacatcactgaaataatgagattttcttctacggtgtgctaccctttctaaactgttctaagaagcaggcagttgatgtatgtttatattttaagtcagctgtcaaggggagaccacagccttagtatgacatcctgcacaatttgtgaagcatttattctactgaaggcacagtcttgtttatactttctgcacattcagtgtattggtaatttaaattatttcagttttaacttgtgaaagcttatattatgatttctggtattttagaaatacattagagtctgtgagtctcattctttaagatacagatgtgtgaacttcaatataaagttgcatttgccaaaatttacccgtgtagcctgttaattttcttgaaataagttttacatttttggcacataacaacgttttttttaatttgggaggcaagcacaaactaggaagactagctttattatggttttgctttttgattcttgtagctactatattccagactggaaatgtatgaatgataatcaacataatgctgataaactgacataatattatctgtaaaagcattatttggtagtttattataatcatccctctattattcttaaatgccagtagtatttagagatgtgtacctgcttagttaattggctcagaattttaatataaacatcacactttaatttggagcatagtaccatagaaatttggggttctaaatatacaacttgtaagaagaatggtttacactaacattatgacaaaactagaaaaagttattatttttgtttgctttctgttgttttgtttattggttggtttttgtgaagtttattttttttttggtatttgataattaagattaggaatctaataacacagaattccatattgctatagtacttctgtaaagagaatatcaatataaataaggaaaataaatcaatgaaatgtttcaatgatatatgcaactattcagttttgctcttataaggacagctcaagccatgaattagtgagcattctgacctcatttttactttacaccaaagttgattagatctgagacaaaatttaatgcacaacagtgagttggatctagcaataaagtctccttggtactgaaatcattatctaaaataaaggaaatgttatcaaaagatgttctgataacattgtgattgtaactcaaaaaaatttatagtagaaacgtaattgcaatgatgataataactaactctgcttagaggttcaaatatcaccagcaatcagtaaaaaattcagcaataatcttaaggccagagagaacaggttcaccattgcatagacaagaaaacagatatgggttaagagttggggactgaggagtcaagagcaacggccacgtgaagctgcctgactccacctagctatttggaataaccgattcccacagttttggtaagaaaccagccccagtaatcagtaagtcaggctgaactgcagtgacttttatttaagcctactcctgactaacttggcatttgcaggtcaagcaggaagcagttgacaagacacatcctcagtgaatcaatgccatttgtaactcaactggtaacagtagtaatcatacaaaataaaaacctgcttcagtgtcttaatgacc

SEQ ID NO: 45954 - DNA, 1844 bp, Homo sapiens
tggtacaggtccgcgaatcccgttgatgaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcaggtaaactctctgaggttttaagagctcagagtgcatgtacatatggtgcgttatgttataaagtcccaga

SEQ ID NO: 45955 - DNA, 1051 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaag

SEQ ID NO: 45956 - DNA, 244 bp, Homo sapiens
aggttatattgaaggggagatgtgcctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagta

SEQ ID NO: 45957 - DNA, 3339 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45958 - DNA, 2691 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagta

SEQ ID NO: 45959 - DNA, 3475 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtaggtggaagccttccaaagagcggcggttgtctgggagccgtctcagttggccgcgacccgggcgcatgcgcggggcgggcggtgcgccttgggtagcttgtcctctccgatcccgggcgctgagggcctctgtacggcgccgcgtagggtctcggccgcagaacgtggccgagaggcccgggcgagacttcgggaccgtgtcctgagcgctctccatgcgcccggcgcgagagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45960 - DNA, 3300 bp, Homo sapiens
tggtgaatatatttaataccagtctgtacaaaataatttcccaggtatcctctcctttaatgtcagaacagcctgcagagggcagtgctgtcatttgtaagtctttttttttttttttaattgcaaaaaatacgtgacataaaatttatcgtaagtagcattgagtacattcacaacgctgtgcagccatcaccactgtccatctcgtgaatgttgtagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45961 - DNA, 2285 bp, Homo sapiens
cagagtccaaacagtgcacagagtccaaacagtgctcagagtccaaacagtgcccagagtccaaacagtgcccagagtccaaacagtgcctaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45962 - DNA, 1730 bp, Homo sapiens
ggcgtatgtgcatcctcggtctccgttatgtaaacggtctgatctgtaaaatagtggtagcacatgccacgtgggatagttggtggagatgatagatggagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45963 - DNA, 3317 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcatgctgggattacagatgtgagccaccatgtccagcatgtttcagacctttaaagtgtcagactaagttaatcttcccgagatccagacaagggaaggcctggctgcatcaagcagattctctgcaaatgcaagttttctccaaaaaagacagctttgcagggctgcttcttttggctctctgaacagccatctgaaaatatgacaaatatattttggggtgaaatatttttatttccctcattcgtgttgctggaactggagcactgtcagtttctataatggcatcttacatggcattaaaataattggaatcattctatagcaatctttttgctttcggaatgttctagatcttattccccgctagagttgtagcgttttcctaatactattagttgaaagtcttccacccatgcatatcacctacacattttctaagccgacattcagtgattatttgtcttcaccgaagaatggcttaaagggttaaagatgaaaaatatagggtacggaagggatgtcagatctgaatgatagttgatttatactgtgtaactttcaaaagtagctactcaatgtgagcatttccactgtttttttttttgtttgttttctgagacagagtctcactctgtctcccaggctggagttgcagtggtgcaatgactgcagcacctcctgggcttacacaatcctgcctcagcctcctatatagcagagaacagaggtgcacaccaccatatctggcttattttttgattttttgcagagatgaggtctcactttgttgcccaggctagtctcaaactcctgggctcaagcaatcctcccaccttggcttcccaaagtgctgggattacaggcatgagccactgtgctcagccttcatgttcacttttttaaaatgtatgtattttttatagagatgtgggtctcactgtgtcgcccaggttgtctcgaactcctggtctcaagcgatactcctgctttggcctcccaaaatgctggaatgagcctctgcatacagagttccacatttttatgctccctgagtcatggtctttgaaatctataaatcaataaaggttggaaacagagaagtagacaagaagttatcagtacttctctttagtaacttgtcatttttatccagagtcaagattctcaaaccacacgtgctttgttaaagctggctataaggaaaactggttgcttggctttttcattgagtctatacaaactgctcaaaagaatgactcttaatgaaagcctgagtgaccctcaaattaggaaattctctcccagataattgagaagtggccttgactgtaccaggtcacacatggaaataagtacaaaagtaatgactaaaataggccaagttgaccgagcactttgtacataggggtattatacgactgcaaattgtgtgatgtttaattgtcacagaaagagatactcgttttaagcacttttagcctaatgtactggaaaattgcttaatggatttttatactctattggaaacatttccatattggtgaaatgccactcattcctttttctgaggagcaaatcttgagtagcaatgggaagaaagcctggcaacagccaccatttgtcttgtggacctgacatgcttattcacctagaaaaagaagaaattgctaaatgcacactgatacctcttaggtaaccacaggttttcattttgtgctgaattattagtcatttttcctttatgtttttagagtatgattcagagaccaatttattcccaaagaaaattgccattacatctactaagttttcatattaaaacattttctaccaagggatgactgtca

SEQ ID NO: 45964 - DNA, 1655 bp, Homo sapiens
  misc_feature (135)..(135): n is a, c, g, or t
  misc_feature (335)..(335): n is a, c, g, or t
gcggccgccactgcactccagcctggatgacagagtgagactccatctcaaaaagaaaaaaaaaagggagagatccattaataaatgttttcttgaaactaagtaagggtctaattaacaactattaaaatctangtagaggatgtaagaatactttaatattcttcttgagttttctctgtttgaacattttcacaataaaatgggtggaaaaactaaagagccaattattaaaaaaccatattgagtttagaaagtaaaactttgaaaacattagctaaatataagcctcataagaagtttaatctgctgtagtatggtttgtttttgttttngtttttttgagacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45965 - DNA, 990 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtaggtggaagccttccaaagagcggcggttgtctgggagccgtctcagttggccgcgacccgggcgcatgcgcggggcgggcggtgcgccttgggtagcttgtcctctccgatcccgggcgctgagggcctctgtacggcgccgcgtagggtctcggccgcagaacgtggccgagaggcccgggcgagacttcgggaccgtgtcctgagcgctctccatgcgcccggcgcgaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggtatggaatcacttggtagattgaacattccaaagatctttgtaagaaatacagaaagaggccgggcgcggtagctcacgcctgtaatcccagcactttggaggccgaggtgggcagatcatgaggtcaagagatcgagaccatcctggccaacatggtgaaaccccatctgtactaaaactgcaaagataagctgggtgtggtggcaggcacctgtaatcccagctactcgggaggctgaggcaggataattgcttgaacccgggaggcagaggttgcagtgagccgagataacgccactgcactccagcctggcaacagagcgagactctgtcacaaaaaaaaaaatcgagaaagaatgcttttcaaacatcaaaaaaaaagtcgacgcggccgcgaattagtagtagtaggc

SEQ ID NO: 45966 - DNA, 1149 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaag

SEQ ID NO: 45967 - DNA, 3573 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtaggtggaagccttccaaagagcggcggttgtctgggagccgtctcagttggccgcgacccgggcgcatgcgcggggcgggcggtgcgccttgggtagcttgtcctctccgatcccgggcgctgagggcctctgtacggcgccgcgtagggtctcggccgcagaacgtggccgagaggcccgggcgagacttcgggaccgtgtcctgagcgctctccatgcgcccggcgcgaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45968 - DNA, 3241 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtggagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45969 - DNA, 3358 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtggccctcttgacttactgtaggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45970 - DNA, 3156 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgcctgggttttttgtttgttttttgttttttaattcaagaagtaggctgggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45971 - DNA, 3242 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggcccggtggctcatgcctgtaatcctggcactttgggaggctgcggcaggcggatcacttgaggtcaggagtccaagaccagcctggccaacatggtgaaaccccatctctaccaaaaaaaaaaaaaaaaaaaaagtgcaactagctgtgcttggtgacttggccctgtagtcccagttgcttgggaggctgaggtgggagaattgcttgggcctgagagctggaggttatggtgagaaactgagattgcaccactgcactgtagcctgagtgacagagcgagaccctgtctcaagaaagaagtattgggaaggttatttaaagactctacttttaaatcaggcgtggcagctcacgcctgtaatcccagcattttgggaggctgaggcaggcgaatcacttgaggtcaggagttcaagaccagcctggccaacatgtgaaaccccatctctactaaaaatacaaaaactaaccgggcatggtggcgggcacctgtaatcccagctacttgggaggctgaggcaggagaatctcttgaacctgggaggttgcagtgagctgaaatcacaccactgcacttcagcctgggtgacagagcaaaactccacctcaaaaaaaaaaaaaagattctacttttagaaattcagacctagatagatttgcatttggataacaaatccctacctatagccatgtggaagcagcttgtcactgtattttaactgtgtaacaattattgaaggcgaaaatagaagttgggtcatctttgaacacctaccttttatcaatgaatatttttagactgttcttcagtatctgagtcagagtttattgtaatttgttatttacaccaaggtggcatcttagtctaccttcagtgagacttgcgtttcaggggaggggcgtatgtgcatcctcggtctcagttatgtaaacggtctgatctgtaaaatagtggtagcacatgccatgtgggatagttggtggagatgatagatggagttaagcacagggcccagcctgtcagcagtagctactattattgttgcccatttcccctgcaactgaggtgagaggttttcctgagtttgaagctgactggcccacagttaaacgtaacagaccagtttttcagggtgtcagccaacctctattagtgttcttaagtacagtttctgttataaaagttcagattattccttgaaaatttggatctacctcccattattatgagtaatacatgcttatagtaaaaaaaaaaaattgtaagaaataaatattaagaagattatggaggccaaattcttaagactttgggggctggggtcagggaggttatattgaaggggagatgtgcctaacatgttactactaaatggccatcccaacacagccaacacttttgtttcccatttttttttgtttcccgttttttaataaaattgagatataattcacataccataaaattcaccttttaaaagtgtacagtttagtggttttcagaatatccacaaagttgtacaaccatcaccaaatcaattttttatagcatttttcatcacccccaaaagaacctcccattagcagtcaatccatttctctcctccagtctttgggaatcaccagtctactttctgtctctatgggtttccctgttctggacatttcataaaagttcatacaatgtatgatcctttggaactggcttctttgatatagcatgttttcagggttcatccatgttacagcatgtatcagtacatcattttattttatggctgaataatattccattgtatttacccatacatcagttgatatttggattattttcgcttttgggctgttaaaaataatgttatgaacattatagaagaggtttttatgtgcacaggtt

SEQ ID NO: 45972 - DNA, 1556 bp, Homo sapiens
tcacgcttcgtggggcgggacgaggagaagccaaacgtaaagacaccaggagtttctcgggcccagctgtggctgctgccggggagccccaagccttggcgggtccttgcggcgaataggagtctggtcaggcgtcaggctagtccgacgaagagtgggtgtgatcagcactggaaaagatgcctgcccctgctgccacatatgaaagagtagtttacaaaaacccttccgagtaccactacatgaaagtctgcctagaatttcaagattgtggagttggactgaatgctgcacagttcaaacagctgcttatttcggctgtgaaggacctgtttggggaggttgatgccgccttacctttggacatcctaacctatgaagagaagaccttgtcagccatcttgagaatatgtagcagtggtcttgtcaaattgtggagctctttgaccctgttaggatcctataaaggcaaaaaatgtgctttccgggtgattcaggtttctccatttcttcttgcattatctggtaatagtagggaactagtattggattgaatgaatagtcttccattttggaaacgttcatccactctcatatttattttttggtgcctgcatgtttgaagactgaagcaggctaaaagctcttgatgaaatttgagggtgctgaagatgttcccactaatttccagccatcacctttggtggggtgggcttcggaggacagtctgtctgaacctgccagtgctgaccctgcagcactttcagcatatgcacatcaaagttggagaccgcgctgaacttaggagggccttcacacagactgatgtggctaccttctcagaattaacaggggatgtcaatcctttgcatttgaatgaagactttgcaaaacacaccaagtttggaaatacaattgtacatggagttttgatcaacggacttatctcagctctcctaggaactaaaatgccagggccaggctgtgtatttctttcccaggaaattagctttccagcccctttatatattggagaagttgttttagcttctgcagaagtgaaaaagctgaagcggttcattgctattattgcagtgtcatgttctgtaatagaaagtaaaaagactgttatggaaggctgggttaaagttatggttccagaagcttccaaatcctgaaatagatgttttaaagatgcaacctcaaacaccaatgctgttgttaaagagcctatggggaattgctgctctttaccaaagaatggttgataggcccagaagcccatcttagttaggggaagggagcaggaagagggttgttcaaatgcccactttccagtttggccttatgcttcatgcagacttgagtgtatgcaggatttcattatctgctgggattacaggtgtgagcctctgtactcagcccatattttgatatattttcttctggtgtttgtcctgtagatatgttgggattatacggatgctaaattgcttttttcatttactattatatcaagagcatttctcaagatcataaaatattttttaatcatg

SEQ ID NO: 45973 - DNA, 352 bp, Homo sapiens
acctccgcctctagcttcaaatgattctcctgcctcagcctcctgagtagctggaactacaggcacctgccaccacacacagctaatttatgtatttttaatagagacagggtttcaccatgctggcctcaaactcctgaacacaagtgatccacctgccttggcctcccagtgtgctgggattacaggcgtgacccactgtgcctggcctagaaaccaaaatcctgtagacaagacagtagaaccaaaatgatctatgtcaaaaaagaagtataaattagtcctaagtgttaattttcttaaagataatatcaagcttctcacagcttttctaatatggaattcataccaa

SEQ ID NO: 45974 - DNA, 486 bp, Homo sapiens
gggtgtagatggatgcatggatggacagacacaacccctttgttggttggctagattgatggatacatgtgtgaatgaatggatgaataaatgaatccaatttacaaattccactgtgggaaaacagaacgctattcttccaaccagagtagcctgcccctttatctctgtctagcacagtgtttttcaaactttagcatcagaatcccctcaagagcttgttaaaacacagattgatgcccctgcccaccagaattatgatttagtagaatcaccggcggccagaatgctcccaactctatttccatgttctctaggaatcctggaccagcccccgacccctgccaaccttgtccttgtccagaggtcccgtaatcttcactgccagcatctcccatttaggtgctaacatctattatcttggatatcagcaacttgccagcactctgtccctgggctgcactgagaattccttcaaaggtggga

SEQ ID NO: 45975 - DNA, 870 bp, Homo sapiens
gctcagttccaaagctttgttcgtctgctcgttgcgataaattttgctactgctcactctttgggtccacactacttttatgagctgtaacactcaccgcgaaggtctgcagcttcattcctgaagccagcgagaccacgagcccaccgggaggaacgaacaactccagacgcgcggcattaagagctgtaacactcaccgcgaaggtctgtagcttcactcctgagccagcaagaccacgaacccaccagaaggatgaaactccggacacatccgaacatcagaaggaacgaactccagacgcaccaccttaagagctgtaacactcaccgagagggtccgcggcttcattcttgaagtcagtgagaccaagaacccaccaattccggacacaagagcagagcagacggcatcagctggagcctggaagggcagtcatgccctgtgtttctgggacaaacgtcccttcacagatagagttttgctcatctccccgctgctggtggagcaggggccaggtgaaggggacctggagagaggggcggctgcgtagctgggacagccccaagctgtcaaacccaagctgcaatcatgcaggagctttaacaagttggggctcctccagtacctcacagtgcagggggcaagagtccctgagccttcagcccctcccagaatgtccctgacaccttttgtaaattgcactgtaacctggcctgccccagaccttgcttcctgcagcctgttcagtgggggctgctttatccctcagaccctccctctgctgggtgtagaggtcgacagggtccttctggttcctgaggccacttacaggacattgtcccccagctttgaatctcacaccagcac

SEQ ID NO: 45976 - DNA, 439 bp, Homo sapiens
ctctcatagtcttggatgatatatacagccagctaatgcaaaaaaaatttcatgttatttttgcttatttttaagtccactgggtgcatcgtggctgatcgctgttctgacatttttcttccctcattaagaaagatgcccctggtgagatacctgtgctgggctcagagcagaaaataaatatcgctggcatccactttcctatactctctgggtgtaattaagaaaaaggcacctgcaggagagagaaagtgcagggtagaaaatggcccagtggttactgctcatgagaactccccagtcttcataaccatccaaatgtcactccttccatgacattcttcttcttcttcttcttctttttttttttcctgagagagggtctcgctgtgtcgcccaggctgcagtgcagtggtgtgatcatagtgagctatgatca

SEQ ID NO: 45977 - DNA, 209 bp, Homo sapiens
ctgcaaagcaggctaagtagcattttttaccagatttcataaatcaggaaatctcatccttctgagaaaaaaagtggccaaaacaagtccttagctcttggtccacccaagtggaattaacttcctctgtaggaagacaggtgccagcaggtggctacagcctgagccctgagcctggcccccgtccagcgtctcatgtggaagccccc

SEQ ID NO: 45978 - DNA, 259 bp, Homo sapiens
aaccctgaaacttaacttgttcaaaaccaaatttattaccttctctcaaaattgcttttttatgctccctatttcagatgagatcaggagcgttgagggtggtataaccagagactatgttccctatttcaattaacactaccgattcacaccatcagccaagtcagaaactttctactattcttctcaactttattttgaaacctcttggaatttcgggccattccctcccgcctggatgagcacactcgttttctgc

SEQ ID NO: 45979 - DNA, 430 bp, Homo sapiens
aatttgaattaatgaaagtacaaataatgaaaaataactctgcagtcagatttcaggatttactggatgttttcccttctaaagagtctgagggttacaaaaacttctttccagggaaaacaacgaaactcatatgaatcctgggtttttcctttgagggaaagtttattgtaaacagaattgtaagggagggagaaaagtgcctatagcgagctctggcattaatgaaaacttgcagccaccttcagagctggtcctgtctgtcagagagtcaagagtgccctggaggagaagtgcctcccatcacatgagccacgtttgccaaatagaaagcaaagcctgggaactcgtcccccagagcagtcggctttggttccatttcctaccagagcaagcagacgggaagcatttcagcctgacaaagaggcat

SEQ ID NO: 45980 - DNA, 602 bp, Homo sapiens
aaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattttttttttaagctacattgcaaatataggtttattttttgttcaggtttttcttttatattttttttctgcacaaa

SEQ ID NO: 45981 - DNA, 158 bp, Homo sapiens
tgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatg

SEQ ID NO: 45982 - DNA, 309 bp, Homo sapiens
gagtcagctccaccagggacgccgctcatgtttaccgacgttcgctggggctccaaacccaggggcgggagccgggatgagaggttaggctaaccctaaccctaaccccgcaggtccccagccttcctccgatcgctcgtggggcgggccgcttcgtccagcagcctcgctctgcgactgacttcacggaggcctggccctgacttccctgcgggcagccctttttaaccccgaagtgaggtgggcatcgtttagatttctgtgggggggcacacaggtggtctaataaggcaggatctgggtccagat

SEQ ID NO: 45983 - DNA, 418 bp, Homo sapiens
tgatccacctgcctcagcctcccaaaatgctgcgattacaagtgtgagtcccattcccaaccacaagtttctagaaggcagaaatcatgtccttgtacccttagagttacaacataaacgcccaaagtcctatattctagtgccagtgtcgaggaaatccaacagcctccagcaggctcaatttcctttgtttttttgattcagagtctccctctgtcacccaggctggagttcaatggtgcgatctcagctcactgcaacttctgcctcccagattcaagcagttctcctgcctcagcctcccaagtagctaggattacaggcacccgccaccacacccggctaatttttgtgtttttagtagagacgtggttttgccatattggccatgctggtcttgagctcctgacctcgtgat

SEQ ID NO: 45984 - DNA, 805 bp, Homo sapiens
gctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatgctttttctatcttctgctctttgccacctgtgaggtccctgaaaatgaaggccaatactacccagatttgaatattctaagagatttctcaaaaagctgatattcataatttgagaagcaatcaagaacaaacgtgtactgaaacagttggtgcaaaatccttattgaccacagatggaattcagtaatttatatttcttcgaaacatagaaaaacggaatactgagatctggtgggggggccggcggcagtctgggagcgggcgccatgtacaccatcatcaacgggcccagcaagttggtcgcgcagcgccgcacaggtctcac

SEQ ID NO: 45985 - DNA, 754 bp, Homo sapiens
gctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatattgtgtattctaagagatttttcaagaagctgataagatattgtaatttgagagtcaacccagaacaaatatgtgcagaagaaattgttggtgaaaacttgatttgttggctatttgagacctaatatatttatatatttaactgatcacagaaaacaggtgtattcaagacacccacattttaaaaatccttatctgcttcagtgggcattacttgtggcctcactgcacttctttgtacaaggctaatgtgtctggttattttgtaaacaggt

SEQ ID NO: 45986 - DNA, 576 bp, Homo sapiens
gctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatagactaaggtgtcagtatgttcttcaagctgctctgctcctgggcccaagctattctcctgcctcagccttccaagaagctgaaactacaagaacaca

SEQ ID NO: 45987 - DNA, 1367 bp, Homo sapiens
gctctggggcctaggacctttgtggtagcagagtcactgcagagaaccagacaataccaggttgcttataaaaggatgccatgtgcttgctggaggtcccaggtgcaaccaaattgcttgcagctaggaggaccttgaagagaaatgggatcagcccgccaaaccaagaagggttagcacttttgctaggagagctgaccacgcacaaacagatgagaaccaaaaccgagtgaagaggattgaagatgaacccacattttaaaagttcttgtctgctggaggtggcattacctgtgacctcgcttcacttctccatacatggctgttatagcagaaaatccagctttctgaagcatatttcacgacatatgatgagacttatgtgatgtgagacctgagaaaactatgatagaaagaagcaactcaagttgcaaggatattcctcatgtatcatgcaaggatattcctcatatatcatgtaagtaaaaagtcaccaaatcctgacaacctgtccacatgtgcccacacatgtacaattatataataaaaagagcagaatgcaatataacaaacatcaatggaatatctattaaacttcttaagagtatcatttctttactgctatatatttgttccacttactgatttttttccagatgcatataattcttacggtttgatcaacagtaaaagaatgctatgagatttaaccataaaaaactatcttgttcctcaagaaaagttaatgatattggagagtactcattttctagtgttgaattgagaattcagggcaccaaattctatgtgtagtgggaccaatgaggatggatttgaagaaaagaaatggaagtgtgtgtgtgtgtgtgtgtgtgtgtgtgtgcgcgcgcgcctagcattgtgctgaggaatgtggggagtatattaatgagatatagattaaatttatttcactgaataacatcagttcttattgaacagttatatatcatttttttaatgtttaaaccaatatactcatcaagctgctaatagtggatgcctcaaaaaagtgggatttgtgataaagtgtttccatttgttcttcatagattgtgtattctaagagatttttcaagaagctgataagatattgtaatttgagagtcaacccagaacaaatatgtgcagaagaaattgttggtgaaaacttgatttgttggctatttgagacctaatatatttatatatttaactgatcacagaaaacaggtgtattcaagacacccacattttaaaaatccttatctgcttcagtgggcattacttgtggcctcactgcacttctttgtacaaggctaatgtgtctggttattttgtaaacaggt

SEQ ID NO: 45988 - DNA, 390 bp, Homo sapiens
tgacccccgagctcccagctcagtgtcacactcgagtgaacagtagatgatgcttctgccgtgcgttttgctggggaaggtaacagccatcgcacacatgtaaattcttgtgtaatccaattcctgtctttgtaattacttggagacttgccatcgcagccaattgagaagtgggagcagtgaccctgggcagaaagcagaaattggagaggaggggaggggcggggaggtggcatccagaacacagttgtagctctcctggctttacagcatctaaaatcacttcaggatcaggaaaaagcaaaaacattataactgccctccacgcaagtaccccagcttttctgtcccaagttcccactccctctacctctctcttagcaggctgga

SEQ ID NO: 45989 - DNA, 1022 bp, Homo sapiens
  misc_feature (519)..(519): n is a, c, g, or t
  misc_feature (524)..(524): n is a, c, g, or t
  misc_feature (545)..(545): n is a, c, g, or t
  misc_feature (592)..(592): n is a, c, g, or t
gtatttttagtagagacggggtttcatcatgttggctaggctggtctcgaactcctgacctcaggtgatctacctgcctcgtccttccaaagtgctggtattacaagcatgagccactgcgcccggccttatctttttttttaatgttcacaggtgatgtttccaagtgttacagccataattccttttttttttcccataagccctgtgtgtttttttgtgtgactttgcatagcatggtgatatttaggaacatgcctctggctcaaccactgactattaacattaacctctccaggatgccaaataggacggcagaacgtttcgacctatctatttagttgtcaatatgatgctaacagtttttttttttctttctttctttccttctttctcctactctttccttctctctctttctgagacagggtcttgttctgtcacccaggttggagtgcaatggcacaatcatggctcattgcagcctcaatctcctgggctcaaaggatcttccctccncagcntccttagtagcagggactacnggtgcgcaaccccacaactggctaattattgtatttttttggtaggntctccctatattgccaaggttggtcttgaactcctggactcaagtgatcctcccaccttggcctcccaaagtgctgggattaacaggtgtgagccactgtgcctggcccacattcttattactaattacaatttctctcttctgtgaattggctggcattatcacactgccatgaattactcttaaacagtacctttaccacagaaagaagtgttgataatgcagtcagaatagctggatgatgctataattttttaaattaaagcaaattttaaaaccttttgacctcaatgaacatttcaaaattaaacataaaataagaatcatattacctaagtacatacactatttaaataccttttacattattgacatattatacaagtatcatatcatataccagttagctaatacttggtgcacttcagat

SEQ ID NO: 45990 - DNA, 403 bp, Homo sapiens
aagacactaaatgtttaatcgttgacatggacgtgtatcctgctgcctgacctttatctgccctgtccccaaccccatacgacacaccccgcctagactgtcgcccgcaatacctcattttatctcagctttagcttttaagggcctccctctcacccactgccttaacttccatgctgacttccttttctgaacttctgtagtagtatcatttgctctagtcattttgcacttacatgtgatatatatatatatatatatatgtggcgaatacattcactggtaaatgctctcctataatgactctgcatctccagcacctagaataatgttgtacaagtactgtagtaggcggtttaaaataaaaaaatgttgctcgtgaatgaacaattttttaagccgt

SEQ ID NO: 45991 - DNA, 396 bp, Homo sapiens
acaaccactctggaaaacggtctgagagtttcttataaaattaaacatacacttagctatgacccaggaatcttctacccaggtatttactctagagaaacaaaatcataattcacataaaatcctgtacagaagctctatttacactgccaaaaacctgaaataattcatatgtccttcaataggtaaatggataaactgtggtacctccacataacggaatactacttagcagtaaaaaggaacaaactgtcgatacatgaaacttatatgaagttcaaaggcaccaggctgaataaaaaaagacaatctcaaaaggttatatatgactacatttatattacagtctcaaaactgtaaaactataaagatgaaaaaagataactgtggacaggg

SEQ ID NO: 45992 - DNA, 456 bp, Homo sapiens
cccatgcttctctgggctgctcaaaagacaccttcacaattctttggtcctgaagcccacatttttaaggagggcattgctgtgacctgtgagttcagttccaaaaggaccttgaagagcttgtttttgaggaaaggatacttagagggacttagatgctgctcattttcagatggtgcagggtatgtgataagacctgattctctttgatcccagaaagctgaacatggtctgattgccagaaggtacttggaggtagaattgagttcattttaaggaagaaccattctccctccctgtctttcttccttttaaaattctattaaagactttcaagagccaggcatggtggcttatacctgtaatcccagcgctttaggaggtcgagacaggaggattccttgagcccaggagtttgagaccagcctgggcaacacggcaaaaccccatgtctac

SEQ ID NO: 45993 - DNA, 381 bp, Homo sapiens
tggagccagtcacagtggcacgtttctgtagtcaagctattcaatgaggcaagaagattgcttgaggtcaggagtttgagaccagcctttgcaatatagtgagaaaaaccctgtatttatttttaaaaaattgtatatttattttttcctgatataaatttccttctgctatgttggattaaagctggaattattcagggtttggtgctgagcctcctccttttctcactcttccctgtatcacaaggaggacacccatgcaagcagtaagagagaaggagcctgagctaggattacaggcacgagccaccgcgcacggccagaggcattcatttctttagctaagtttttttttcttagtaggtttttttctcccaggct

SEQ ID NO: 45994 - DNA, 333 bp, Homo sapiens
gtcgcctgggggccttgctaaataaaaatgcagcttctgattcaatagtctcaaacaggaccagagattctgcctgtcttgatgagttctcgagtgaggcagacaatgccagttcacagactcacactttgagatacagcacctgggccattgtattctaatgtgcttgataacctggagcacctattaaatatccaagttgtcaggactttcttctggaaatcttgattcagtatgttttgtttggagccttagatgtttgggaaaactagaatttctttctttccctttagacaaaagtcaactactgctgaggcatgggcttaataaatg

SEQ ID NO: 45995 - DNA, 865 bp, Homo sapiens
cagccgtttcccacgtatctcacaatgtacttctctggtcttattagaactaaatgagtatctcagtccataatcacagggagaagaaccaccacagaccacatacctggggtcttgaaaataattccatgcatgtgggactttcagaagctctccatgtctgtccagaagggccccacaatatactggggggactttgtatgtggctcagcatggagcaggggcaggatgttcattcccactcatccccttggccaagtgcccttgtgcagtgaacaaactgcacaaccatgctgggcagaagcattttatatcagtccccttcggacttagtctcacaggcatcatttgatggggggtgggagatgaagtggttcttccttttctagatactttattctataagttggatcacctcaagcaaatgcctgagtgcagctagccaagttctctatctcacagtcttcatacagctggctgtcgctgatgagtgagtgagctgcgaaatcagcttaaaccacaacatgttatttttgaatttgaataaaataggaaaaggcagagtgcattgtgtgaccatggggtaagacactctccctttctccttctcagttttcctgtcataaaaggacaaactactatctaagttctccgtagttaaaattcttttttgttgtttttttttatttgagacagtttggctcgttccccaggctggagtgcaatggtgctatcttggctccctgcaacctgcgcctcctggtttcaagcagttctcctgcctcagcctcccaaatagctgggattacatgcctgtgccaccacacccagctaatttagtatttttagtagagatggggtttca

SEQ ID NO: 45996 - DNA, 572 bp, Homo sapiens
acactccagcctgggccatagagtaaggccctgtctctaactggaagtccaaagagggatctacttccaagactattaatttaatagatcaataaattaatcaagaatatgatttttttctcatctttctttgtagtcatattttatacagactttttgtttaagtaatctctctttatgggcagacaatgatttcagaaacaccacaaattattctcaaaaagaaaagacgaggatttttttttttttagaaaatgtaactcttttcagtagctcttggcagacctaccctcacattttcttgactaaaagcagtcattaaaaaaagtcagtcacaaacaggtgaatttaaattatcatggtttacctatagttaacaagctttatcctcagaggtaaggatagggttactttcctgaattttagatatgtggaaatatttggagttatgtcaataaatgaaaaagtatgatggatatagtgcttgccatggaatatatcaaatacagatattctgaaaactttaagttcagtaatatgccaggggttcccaagaccacttgagacctggt

SEQ ID NO: 45997 - DNA, 344 bp, Homo sapiens
tctctgaacagccccagtggcctccctcaggatgaaaaccactcttcagctaggcatctgtccgcttggtgattcatttattcattcattcaacaaaccacatccacagaatagaagactgagagacatcaaatagaaggagacggatgcccatgagctgacatgggatcgttgtgatgactcatctggccaatatttatcaaacactgagaaaaacagatgaggagccgggagcagtggctcactccttgaatcccagcactttggaaggttgaggtgggtggatctctcaaggccaggaattcaaaaccagcctggccaacatggtgaaacctcatctcaac

SEQ ID NO: 45998 - DNA, 343 bp, Homo sapiens
cttaaactactccctgatggtgaaaaataacaatgaaatatacagctacccttgagaagttcacattctcactggtcacctgcctccagtttgcccccaacttccatttcagcctccaggtcactgccagaatgagcttgtaaaacacacatgggatcttctcacctataggataaagataaatccctaggcatggatcacgaggtcctttgtgcattggctcctgcccttttctctggtcttatttcccatccctctgtgtgttctggttgtacttaactacttgtaattttaaaaactcaacttgctgtctcctgcctcaaggttgatctataagcggttt

SEQ ID NO: 45999 - DNA, 449 bp, Homo sapiens
actaaactgtctcgaagactagacaggaaggaaaaccttgaattactctcacataattccactccagatatctcaacagcaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagggtgtggaaaaacccatgtggaattgaaacagacccacttaagcacgcacgcgcgcacgcacggtctcaggagctactgatttgtggacccctttttgacctttggtatttaaag

SEQ ID NO: 46000 - DNA, 417 bp, Homo sapiens
agtggctatccaggagggtctttggtggaaaacattttttaagagtagcttttgattatggaaatgttgaaacgtccataagaatagaggggtggggtaatgagccctggagtgcccacagcaccgagtgagtggtccttcacaggaaacagcgcttggttcctgagcaggaatactcggttacttaatggctcgtgcctgcagcctcaccatagcaggcacgatctttctacgtcaaatcaaagtctccgtcgaatgcttcttacagttttgaacgagggaggtgatggtgggacggtcacgggtgttaagaattactgaattactgttgcgtttgagattcacgttccccctggtaggcatgatgttttagtgtatgtattttttctgaaatacaaaaaaaaaggtgttctggga

SEQ ID NO: 46001 - DNA, 658 bp, Homo sapiens
attgcttgaacccgggaggtgcaggttgcagtaagctgagatcacgccattgcactgcagcctgggtgacgagcgaaaatctgtctcaaaaaaaaaaaaagagttcctgttttgtcttgtgggtttgaaaaatatttatctcttacttacaaagcattggctctatgacctccctgcagatattcttgtattaaacagtgccatcattgacactgattttacatttgatgggtagaggacatttgtggtttgagaaaaagaactccctagattactctaatgtactcttacgtaccttaaggctttacctactcttgacactgttaaaaagaatgggtgagcgtgtgccagccttttcccatttcgggatccaggagagaaatctccatacgtaagtggaatggaatttagaaggaaggtgggtttccctctgagtgttggcaactcagctgaaaggaaaggagaggatatagaaacgagttatgagattgtttcttcctaaactgtatttcattataaacctatctttaagtgccatttggttcaaactacaatactctgtgtctttaaatttgaaaggttagaagtaataatactagggagagaagaattggttttatctcctaatgagtactttcaccttccataaggtttttga

SEQ ID NO: 46002 - DNA, 603 bp, Homo sapiens
ctagagactagaaatgagtgaagagaactgggctttgggccacagttggggtttctgggagagccttggaaagatttgtggagagccatcctggtggtttggcggctgcaggtctgggactggttaagttttgggcaactctttgctgagcccctgggaggttctgggctaggaggtggggaaggtggtctctgctttcagagtgttatgttactcctgggaggagaaggacatggatgaatgacccagggggcattcttggtgggtttggagccagggagcaaggctgcgggactggagacatctgaatgtcatgagtccactcttggggacccccacagactggggcttaaatcttagctctttactcctaagctgtgtgacttcaagtcgcttaacctcctgggcctgctttctcttccccatctgtagaagaggggctaataatattcacccagggctttggtgagggtggagatgatttaggtgagacaggagcaagctgctgctgccgcctctggagctactgggggtagcttgtccctgagtagagaacaagctcccagcctgtgcatggaatcaggaggcatcccagggcatagg

SEQ ID NO: 46003 - DNA, 664 bp, Homo sapiens
ctgacctcgtgatctgcccgcctcggcctcccaaagtgctgggattacaggcgtgagccaccgcacccaggctgtccagagtttttattggtgtaggtttgatcaactgttcacatggcttatctgtctccagtccctcagtagtttgaatgaatgggcttgcttgtttcgtgtgttgtgtcctggcttgtgtgtttgtccagaaaagttgtttctcctcctttctttcctactggcagggcagtacctggctcagggctgtgcttatggtagaactcagttctatgaattgtccatcctcaaatatccttcattacatgggggaaaagggcaagcatcctcctctagcctcttcccactgcttaataaagtgtctccctttcagtagctgccctaattctggatcctctccattctgacatctggaaattcacaggaggaaggagtgaggaaatgaatcccttctaagtgggtttgtgtgaggtgactgatatgtcagatatctcacaagaaaaacataatagcggtagtttgttgttccatcctttcctgtgattatggaataatgaatgcgacaattcctggggcgtggtggcttacgcctgtaatctgcgtggatcataggatgtcccataaaataaagcttttcattatcacatgatcc

SEQ ID NO: 46004 - DNA, 452 bp, Homo sapiens
cttccctttgggcagtgatttgtagtcaggctgcagggctgcttctgatttccttccctcctcatcactctccttgtctctcttaattgttctcccctgcccctacttttttttatttgaggatatgtcccagtttggtgagggaatgttggctgaaaaatgagagaaattccttccttgactgctttgttaagaaatcttattcacctttctatgtcaagagtatgaatcttggttagttcaatgtggttacaaaacttatatgccagtccctcccaacatctggacatgcctgtagataaagatcagacttgaacataacagtaatcctgtaatctccctgaagtctcccttggttgtcagtgtaattctaaacctgctggattattattgttattgtcatcattattattggtataactgtgaaggtgaagataattgcaaaataaaaa

SEQ ID NO: 46005 - DNA, 433 bp, Homo sapiens
ggtggaaacaagccaaccacaccagctacccgtgggggtagggaatgatccctcagtgccttttatcccttggcaagccccaagatgcctactggcctgctagcccggagattttataatacctgaagaactcctgagtgctcaagcagagggagggaataaaaggtgagggcagaattcgatttaccagctccacaggccatttccctcaccggttctcaaggattaggatgctgagaacagtcagcaactgggggacttctacccttccctcccctttgttcactgggatgggaaggacaataaagcggcaggctggagagactgaggggctggttagagatttctcaggctgctttttgaaacacttgaaggagccggtccatgctattgttgtagtaaaatagaaagcggaactattctccttttgcaa

SEQ ID NO: 46006 - DNA, 336 bp, Homo sapiens
gttacttgcagatcagtttgatcctttccaggcttgctttaaggcttttataagtgggagtctagagtagacttttacttgagagctagtttagccctactgctaaggagtgaccattctggggcctctgcggaaggtcttgtgtctgaggtttgtctattctgggtagtggaaacttgaataattattggccccgtgtaagctctgagaattcttcagtctgtagtcacccagtaattcttctttccccagaagttgttttggccagtcttctgaagttccaccctacatttgcatagattggtatacatccgaagacctaagggaccccatgca

SEQ ID NO: 46007 - DNA, 428 bp, Homo sapiens
aaggcctccaaaacccaaagttttaaagtgcttgcttaagattttgggggctgattcacctaaagggatctaaaaattgcattttttttcctccaaaggaccaagcacagaagttgtgccagtggtttccctgttaactcctgactggcctgatttttgcttctcagacttataattcctaatcacctggtaggtgccactcgggatggtcttctgcctctggttagtcctgagcttgttttctcactggtgcagcaggaccttagaccaaaatgacctccagcatcctgtgagtcttggatctctgtgggatccgacagtcacccttgccccatgcttcgggttactttgtctattccacaattattgggtgcctactctctgcaaggcatcaggagtccttgaatattaccttattcaagacatgc

SEQ ID NO: 46008 - DNA, 477 bp, Homo sapiens
gtaaatactcgagagaaaactgtacaagttcacttactatgatgagttaaagaaaaacctaaataagacccaacagtacattgcaataataacatattatgaccaagagtggttcattcttgaatagcaaagatgttttcatattaggaaatcaataactataattcattatagtaagagattgatagaaaaaagactaaaatctcctttaatatatgcataagaggaatttaataaaatccaacattctttcctaataaaaatcttgaataagtatggattatgttatgctttcttaactaaatgtgaatttatatttatacatacacacatatatacaaattatatacacatatcaaaagatcaatataaaataataaaggtcatatgatatttagattgaatggtaatattttagaagtactgcaaatcaagtcaagatcaacttaagattatcttttatcaccagtgctatgt

SEQ ID NO: 46009 - DNA, 361 bp, Homo sapiens
tccactcagagttcagttcgtactgtacttctgccattatctcattattatgcggggtagcaggctgaatctaaaaatctgaaagaatctgttgtcccacccacagatccaattgaaaataaaagacaggagagggagaataaaaattggcctataccacctcctccagttgcagaaacatctgtactgcctcctttggtggcaaaaatagagaccccccaatacagagaatttatgctctgctgtcatagccggagagcccttaggaccttgtgcttttcctatttccgtaacgcctgatccaaataatccgcagcaggttattcacgaacacactccactagagtttaagttgttaaag

SEQ ID NO: 46010 - DNA, 187 bp, Homo sapiens
cacctgttgtcacagctcactgatggaggttttaagcccaccctatgtgactccactgggagaggactcctgtaagctctggaagcttgcacctggtttcctccagacttcacgtgccttttcctttcgctgattttgctttgcatctatctcttcactgtaataaatgacagtcatgagtacagct

SEQ ID NO: 46011 - DNA, 857 bp, Homo sapiens
aataaagagaaccagtataagtaactacatgtgtaagtttaaaacaaagtataaatttattttgtttgtaacatttgtcttttcctatttgatttaaaatataatctcaattataaacttgtgttgatggtattatataaagatgtaattttgggttatagcaccaaaatggcagaataggaattttctgtaggtgtttcccacataagtatcaattttgacaaccatccatgggcaagagtaccttgtgggagttcaggagttgacagtaaaacttcagcacaccagaggagtaaagaaatctaagaatagattcattggaaagggtataaacagtttcactttacctgcatcaccaacccccaaaagtggcacagctcagttaacaagagcccattatttcttccacagaggaaaaggagagtataataagtaagtgtccagtttctcaagacatacaggcccctgcccaagagatccactttattttcatctcacccagaatattgaggtgatcagcaaggtggagtggttgggagagggtaaaagcaggaaagagagatggggactcaaacagcagcccatacttggaactgccatagatcctaccagttacttcatggactccatcaggaacccacctataagccacaggggatgcatccctcccatcttgccaacaaaaccccgaatgctccaaatgcctcacccactctttggctggctcccaagtgcgctcctgtgaaaagcgagtgagtatctctgcagatggcttgcaagcacatgttgacagctggctccactctgtagaactggaaaaaagctcacatacatgagaatttcaggacactacccta

SEQ ID NO: 46012 - DNA, 442 bp, Homo sapiens
gtttttgtatgaacataaactttcaacttatttaagtaaataccaaagagagtgattgctggatcatacataagagtatgagccaccatgtctggccgagtaccacattttctttatccatttatctgttgatggacccttagattgcttccaaattttggctgtcgttcgtgaaccatgctacaacaaacatgggagtgcagatatctctttgatatactcatttccttttttttttttttttggaaggagggcatatacctagcagtgggattgctggattatatggtacctctatttttagttttttgaggaaccttcaaactgatctccatagtggttgtactaatttacattcccacagtgtacaaggggtcgtcttttctcttttttgattgtttcctttgctgtgcagaaggttttcaacttgatgtgatcccat

SEQ ID NO: 46013 - DNA, 510 bp, Homo sapiens
tataatgaactcttacaactcaataagactggtaacccaattaaaaattctttttaaaaaaaccaatttaaaaataaaggcaaataacctaatttttatataactcaaagtttttaaagaaacaaaccaatttaaaagttccaaaggatttgaataaacgtttttccaaagaagatatgtaaatagccaataaacgcataaaaacgtgcataacaccattagctattaggaaaaggcaaatcaaaaccacagtaaaaagcagcttcaaagccactacatggttgtggtcaaagagaccacaaataacaaattggaatctttatacatagctggtgggaatgtaaaatggtgcagctgctttggaaaacagtttcacaagttttcaaaaggttagacctaccatataacctagcaactctactcatatttatatgtcagctacaaataaaaacattaagttcaccaaaatatttacacatgaaagttcatagcatcattattaaaatcaga

SEQ ID NO: 46014 - DNA, 387 bp, Homo sapiens
tatggttctgcacgtgggtccaatccaatccctaagaaatagtccttaagtcttatggtttagaatgtagagttactctatacaacagggctaacctgaattggatatctgcagcatgtgtgtggcttcatctctacgtggcatcatcctcaatcttctttcttcctgatatcaccacttggatattaagatagtaaacttttttttttttttgagacggagtttcactcttcttgcccaggctggagtgcagtggcgtgatcttggctcgctgcaacctccacctcccaggttcaagtgattctcctgcctcagcttcccaagtagctaggattacaggtgcgtgccaccacacctggctagtttttttgtatttttattagagac

SEQ ID NO: 46015 - DNA, 539 bp, Homo sapiens
gttttctgcctgcttgttctagtcactgttaggagaggagttgaactaacacacaaggttggcttaccacattagtttgacatgaatctcagagatgttacccgtagctgattacttagtaactttaaagatacaagtaatatcctcacttgtgtgctcaggcaaagtggggagagatgtgggagagtctgtgcaacccccgcaggtccatcctctttgagcccggcctgcgagatgagacctctcactgaggcgtgtggtcctctcactgaggtgtgtcgtcatctcactgcacaaggagcattaaggatgtgcagtgttcccgttttgtagtcagatagtttatacaccttagggaaccttttccagggagccatgtcccataagtccatggattttaggtatgtttaccaaacacaatcctaaactaaccacatcttgctaaaaacatttcatagataaggacacttctcctagcaaataccagtcatttatttacagagaagccagtctcagtgttctgggagatcagccccagt

SEQ ID NO: 46016 - DNA, 436 bp, Homo sapiens
atcatcagagttttgattcagttgctagtgacaggccattagacaaactacttagccaactggagcctcaatttcattattgatcaagtgaaggtctgtcatcttttccccaagagtgtactgaaaataaaattataagtacaaatgtgtggtcctgcatggtggctcatgcctgtaatcccagcactttgggatgcccaagcgggaggatcacttgaggccaggagttcgagaccagcctgggcaatgaagtgagacccccgtctctacaaaaaataataataaattaatcctgcatggtggcatgtgtctgtggtgtcagctacttgggaggctgaaatggaagggttgcttgagcccagggggtcgaggctacagtgagccgtgattgcatcactgcactccagcctgggtgacagactgagatcctgtctaa

SEQ ID NO: 46017 - DNA, 381 bp, Homo sapiens
gtcccagctactgggaaggctgaggcaggaggattgctcaagcctgggaggtcgaggctgtagtgagctgtgatcacaccactgcactccagcttgaacgacagagtaagaccctgtctcaaaaaaaaaaaaaaaaaaaaagctggtgaagaagggaaacaccacttggtgtgagcgccatctactcagacagccagggccgtgagtctgcagctccagacccggctatgcctgtaaccttgtgtggatctccatgtctaacaatgggctctgggttttgagctccaggcaggggcctgggagaaggaagaagaagaggcttccttactccccactggcaggggagtcaagcctggtgtgtcacgggctcaccccacgtcc

SEQ ID NO: 46018 - DNA, 547 bp, Homo sapiens
tcttcaaaaggacttcacacagcccctgccctgtgcagggcggagcgggcagactccttcccaggtgcccttaagagtcctgggcccccacagtggctttgcgagccccattgtgtcgcctctgaaatcgttttgccgaagaagcgtgtgtgcttgcaagtcaagagccaagggagagagtggctgaggtttcctggtgggccaagtgtggggcgtctgctgggaccctgagtgagccgcccggcgatggtgcgtttgagctgtggtgtctgcaccactcacatcacacaggtcaggcttctttgatttatggagataagcccgtgggcagcctttccagaggctggggaggaaaagaggagaccgtgcagtttcgcagagtcctggtccattgctgctcctgtaacaaaataccttagactggagggccgggcacggtggctcacgcctgttatcccagcactttgggaggctgaggtggacggatcacttgaggccagggttcccagaccagcctaggcaacatggagaaacctcatctcaaaca

SEQ ID NO: 46019 - DNA, 562 bp, Homo sapiens
ctcattcttccgctgaggctagagtgcaggagtgtgatatctgctcactgcagcctccgcctctggggttcaaacaattcttgtgcctccgcctcctgagtagctgggattacaggcgtgcaccacaatacccagctaatttttgtatctttagtagaggcagggttttgccatgttgtccaggctgacttagaactcctgacctcaagtgatccgcctgccttggcctcccaaagtgttgggattacaggtgtgagccattgcacctggcttcaaatgttattatttaaaaagtgttaccaccttagatggcattagttgcattgtgcatagtgaaaggaaaatgaatgagcatgattgatgcacagtcccagcagaaaggaaagaagtctttctgtgcactggtcaccaggtagcattgtaggccaaatgctgcttgcttgtcaccctgcctgagtggtgccatgtagcagtacagagagagtgagtctaggggaaggcataaactggaggggctagtgaaggttttttgcttttttattttccttgaagaaagaagaaa

SEQ ID NO: 46020 - DNA, 393 bp, Homo sapiens
aaagagatttaaacaggaacctgtctatcactcaaaggttaagaactcctagtattaagaatttagtagaaataatatttaataatttagatatatggagtagtggaacaagcaagttataaaagtatgattcagccaggtgcaatggttcatacctgtaatcccagcactttggttggccaaggcgagaggatcacttgagcccaggagtttgataacagcctgggcagactctgtctctactaaaaaaaaagaactaggtgtggtggcagcatgcacctgtagtcccacatactctggaggctgaagtgggaggattgcttgagcccagaagttcaaggctgcaggaagccactgcactccagtctgagaaacagagccagccccgtgcct

SEQ ID NO: 46021 - DNA, 340 bp, Homo sapiens
gggcaagaagagtgaaactccgtctcaaaatagaggaagaagaaggagaaggagaagaagaagaaggaagaagaagaagaaaacaataatatgagagaatttaacaagagagagtggctgagaccagaaagaaaatctgtccatgtgaagatttggggaagataatcccatgaagtgggaagaacaggtgcaaatactgtatgtgtgggtttcacaagactggaacatagcaaaggaagaggaggagtaggaggttacaacagacagataggcaaaagacagactacaaaggactcagaaggaatttgtgccatatttgactttgagtgggaaatctatc

SEQ ID NO: 46022 - DNA, 1728 bp, Homo sapiens
tgctgagctggaggccgagagcctctggccgagaggcccaggccgaaacagaggctccttcgccctatttttcctagagtggggatctaggattgctaatgaaaacagagaaaccagacttagcgccgactccagctcccgcccctacatctggagtaagagaaaaggccccccgctcctccataaacgactcgaaaacgggcggttgtttataaacttgtggatccggttgttgagcgctgcagcgccgaggcctccccgccggctagggtagcgctaaccttggtagcttctctgcaggggctgggactcccccatcgtatcctttcctctctggttcactgtctcctccggcgcaggaagctccgggttggtgtggaaccaggtatcctctctgaatttctctttccacttttctcgccctcgcctttcctctgtccagaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaaa

SEQ ID NO: 46023 - DNA, 1441 bp, Homo sapiens
  misc_feature (22)..(22): n is a, c, g, or t
  misc_feature (25)..(25): n is a, c, g, or t
  misc_feature (28)..(28): n is a, c, g, or t
  misc_feature (36)..(36): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (49)..(49): n is a, c, g, or t
  misc_feature (76)..(76): n is a, c, g, or t
  misc_feature (122)..(122): n is a, c, g, or t
  misc_feature (218)..(218): n is a, c, g, or t
  misc_feature (1184)..(1184): n is a, c, g, or t
  misc_feature (1204)..(1204): n is a, c, g, or t
cagccccctctgcggctgccgngcnggncgggcccnggngncngggggntggggggtgggggaggacgccgagcgntgaggcaggggcccgggccgagggcgcggcggggctgcgcgcacgntggggcgcgtggaggggcgcggagggcgaaatgagtctggtaggtggttttccccaccacccggtggtgcaccacgagggctacccgtttgccgcngccgccgccgcagctgccgccgccgccgccagccgctgcagccacgaggagaacccctacttccatggctggctcattggccacccggagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtgcaggccgaatcagacccggcgtgggcgaattcagaagtgcccaggtagagacaagctagaggctctgcggacttctgcgggcggctgacaaccgcgagggcgaggggagaaagncatcaggtcctagacgtggnagaaggagcctaccaaagtgttggagtaaacagtggcggaggaggtgaggttttaaaaacaggaaacggagaggagttatcttcaccatgcacctacgcttctctgcaccttgtgtagctggtctccgccatctgggccttaaggcacttctgcagatttaacactttctctggcttattaaacaacaacagagggaaaccaaaagaccctggcgcaccattgctacggagaaactt

SEQ ID NO: 46024 - DNA, 1571 bp, Homo sapiens
tgctgagctggaggccgagagcctctggccgagaggcccaggccgaaacagaggctccttcgccctatttttcctagagtggggatctaggattgctaatgaaaacagagaaaccagacttagcgccgactccagctcccgcccctacatctggagtaagagaaaaggccccccgctcctccataaacgactcgaaaacgggcggttgtttataaacttgtggatccggttgttgagcgctgcagcgccgaggcctccccgccggctagggtagcgctaaccttgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaaa

SEQ ID NO: 46025 - DNA, 1669 bp, Homo sapiens
tgctgagctggaggccgagagcctctggccgagaggcccaggccgaaacagaggctccttcgccctatttttcctagagtggggatctaggattgctaatgaaaacagagaaaccagacttagcgccgactccagctcccgcccctacatctggagtaagagaaaaggccccccgctcctccataaacgactcgaaaacgggcggttgtttataaacttgtggatccggttgttgagcgctgcagcgccgaggcctccccgccggctagggtagcgctaaccttggtagcttctctgcaggggctgggactcccccatcgtatcctttcctctctggttcactgtctcctccggcgcaggaagctccgggttggtgtggaaccaggtatcctctctgaatttctctttccacttttctcgccctcgcctttcctctgtccagaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaaa

SEQ ID NO: 46026 - DNA, 1993 bp, Homo sapiens
  misc_feature (22)..(22): n is a, c, g, or t
  misc_feature (25)..(25): n is a, c, g, or t
  misc_feature (28)..(28): n is a, c, g, or t
  misc_feature (36)..(36): n is a, c, g, or t
  misc_feature (39)..(39): n is a, c, g, or t
  misc_feature (41)..(41): n is a, c, g, or t
  misc_feature (43)..(43): n is a, c, g, or t
  misc_feature (49)..(49): n is a, c, g, or t
  misc_feature (76)..(76): n is a, c, g, or t
  misc_feature (122)..(122): n is a, c, g, or t
  misc_feature (218)..(218): n is a, c, g, or t
cagccccctctgcggctgccgngcnggncgggcccnggngncngggggntggggggtgggggaggacgccgagcgntgaggcaggggcccgggccgagggcgcggcggggctgcgcgcacgntggggcgcgtggaggggcgcggagggcgaaatgagtctggtaggtggttttccccaccacccggtggtgcaccacgagggctacccgtttgccgcngccgccgccgcagctgccgccgccgccgccagccgctgcagccacgaggagaacccctacttccatggctggctcattggccacccggagatgtcgccccccgactacagcatggccctgtcctacagccccgagtatgccagcggcgccgccggcctggaccactcccattacgggggggtgccgccgggcgccgggcccccgggcctgggggggccgcgcccggtgaagcgccgaggcaccgccaaccgcaaggagcggcgcaggactcagagcatcaacagcgccttcgccgaactgcgcgagtgcatccccaacgtacccgccgacaccaaactctccaaaatcaagaccctgcgcctggccaccagctacatcgcctacctcatggacctgctggccaaggacgaccagaatggcgaggcggaggccttcaaggcagagatcaagaagaccgacgtgaaagaggagaagaggaagaaggagctgaacgaaatcttgaaaagcacagtgagcagcaacgacaagaaaaccaaaggccggacgggctggccgcagcacgtctgggccctggagctcaagcagtgaggaggaggagaaggaggaggaggagagcgcgagtgagcaggggccaaggcgccagatgcagacccaggactccggaaaagccgtccgcgctccgctctgaggactccttgcatttggaatcatccggtttatttatgtgcaatttccttcccctctctttgaccccctttgaggcatctgctccccgtctccccctccaaaaaaaaagtggatatttgaagaaaagcattccatattttaatacgaagaggacactcccgtgtggtaagggatcccgtcgtctcatagattctgtgtgcgtgaatgttccctcttggctgtgtagacaccagcgttgccccccgccaacctactcaaccccttccagataaagacagtgggcactagtgcgtttgtgaagtgtatctttaatacttggcctttggatataaatattcctgggtattataaagttttatttcaaagcagaaaacagggccgctaacatttccgttggggtcggtatctagtgctatccattcatctgtggtcgttccctctttgaagatgtttccaacagccacttgttttgtgcacttccgtcctctaaaactaaatggaatttaattaatattgaaggtgtaaacgttgtaagtattcaataaaccactgtgttttttttttacaaaaaccttaatcttttaatggctgatacctcaaaagagttttgaaaacaaagctgttatacttgttttcgtaatatttaaaatattcagaagtaaactaaattatcatgattgcctctaactttattttaaagactcagtggttccaaccagtcaccctgacctgcggcctacgcaggaggaggaggtgctcttaaagagaagtgtccttgttacaaatcctgcaaatggtctggggtttgtcggtgtggtgtctccttccctcttcccccagctggagaacgctgagtagtctctagaaggaagatctgggctggagaacccagtccggcagttcgctcagaaggtgtaaaggtgctcttgctttcctgaagtcaatcagaagccatttcttgaggccgtcagtttttgtttggagagtgtttctggtggaggagttgtgaggagaaccccggcattattgctgcaacgggaactagtctggggtgtttaattcaaactatggggctttcatccaagaaa

SEQ ID NO: 46027 - DNA, 403 bp, Homo sapiens
actattaaatagtggtttaattttccaattttttcaaaaatgtcattgttttcttatttccaattctaaaaatagtctttatttttttacagcagtttcaggttcagagcaaaattgagcagaaggcactgagaatttgcatttccccttgccccacatttgcatagcttcctcctttaggaacacccttcccagtggtacacttcctatgattgattttatgatagtttgttcatttgaaacaggatccaaataaaggcagtacactgtgattgattgatatatctttaaaaggccattttactctgttaaaaaaaagcttaaaacgttttttttgttttttgagagtggaagtcttgctccagcctgggtaatggagtgagactctgttaaaaaaaaaaaa

SEQ ID NO: 46028 - DNA, 2222 bp, Homo sapiens
gtaggccttcggaacagcggaagagcagtgtcgggccatggccagggcccgcaggctggagctggccgaggccctggcgctggggccaggctagaggcatgcctgctatgcgctcctgcacgcgccggaccctggaattctctctggccgcctccctctgcgctacgccatactgatgcagatgcgctttgatgggcgcctgggcttccctggcggattcgtggactcgcaagacagcagcctggaggacgggctgaaccgtggtctgctggaactgctgggcgaggcggcggccgccttccgcgtggagcgccctgactaccgcagctctcacgccggatcaaggccacgtgttgtggcccacttctatgccaaatctctgacgctcgagcagctgttggctgtggaggccagcgcaacaggggccaaggaccacgggctggaggtgctgggcctggtgtgagtgcccctgtaccctgcatgatggtgtgggaggcctgcccatctttctggagaattgctttattggtgctgcctgggagcagttactggataccctccaggacttgggagtggtggaagctggtgctttctcaggacttcagatcccagttcgtctgaggcaaccctctgtggactcagggaacctgagctgaggactttggtacaaggaagggaatgttttctcttccggacctaaagacgataccaaattaaaagaagacatgtatatcatatgttttgagcagaggaccctccaattcatgggatcaggggcaaaaatccacagctcatcccaggggccctggcaggttctcagagcctacctcttccttgtatatttgcatacagcctggtaacccccaggcatgcatatgtacaatgtgaccacacacagcctgacatctttcacctgtcaagtccaatttaaccaggaattggcatttgttaccataccctgcctcttgctttgcagagagcttctacagcaaggctgagtccttcccacagtcctccatgcctgctctttagggtctaccccagcccatgttttttgggaaggatagagaagcagaggaccctctttgctttcctgaaagtagccatgcccttgctggagggttcaccacagcaattggtgggaaagggtcttaaccaatctccaacacttttcttctcctgaaactgagaaggggtaaggaagtagctaggtccccttggacggagcatggacatgagacctgtgagtactggtgtctctccttcagagctttcatctttggttcgctgtagactctgggactatcagaagagaactgacccatacctgtctagccctgcccttccaaaaaaagagcctcccattaaagaggagttagagctgggccttgaggctcttcacttctttcaacagatatttaatatgtacctactaaatgccaggtactataaaaggtatagagagccatccttgctctccaagactccagggaagggatgggcaaacattttcttaaaagccagatagcaaatactttaagctttgtaaactacatagttttttaaaaaatattttctaacattgactaataaaaattgcctatgtttactgtgtacaaaatgatgctttcaaatatgtatacattgtggcgtggctaaattgagctaattaacatatgcattacctcacatatttatcatctttcatggtaagaacacaaaatttactcttagcaattttcacaaattaatgcagtttattaactatagtcaccatttgtgcaacagatcttttgaacttatttctcctaactgaagttttatattcttcgatcaatatcttctcaattactgttccctacccccaacccctagtaaccattattttactctctgtttctatgtgtttaacttttttagatgccatatataagtgaaatcatgtggtattttcacctggcttatttcatttaacatgtcatctaggttaatccatgttgtcacaaatgacagaattttcttctattttaaggccaaatagtattccattgtgtatatataccacattttctttatctgtttatctgttgatggacacttaggttgattccacatcttggctattgtgaatagtgttgcagtgaacatgggagtgcagctatctctccagatcctaatttcaattactttgaataaataccctgtaatgggattcctggacc

SEQ ID NO: 46029 - DNA, 1720 bp, Homo sapiens
gtaggccttcggaacagcggaagagcagtgtcgggccatggccagggcccgcaggctggagctggccgaggccctggcgctggggccaggctagaggcatgcctgctatgcgctcctgcacgcgccggaccctggaattctctctggccgcctccctctgcgctacgccatactggtgaggagggcgcgcgcccggccactctccgctctggccttgcaccttccttgcggcgctactctcgggtgtccctgccaatcccagcttcctcctctctcagatgcagatgcgctttgatgggcgcctgggcttccctggcggattcgtggactcgcaagacagcagcctggaggacgggctgaaccgtggtctgctggaactgctgggcgaggcggcggccgccttccgcgtggagcgccctgactaccgcagctctcacgccggatcaaggccacgtgttgtggcccacttctatgccaaatctctgacgctcgagcagctgttggctgtggaggccagcgcaacaggggccaaggaccacgggctggaggtgctgggcctggtgtgagtgcccctgtaccctgcatgatggtgtgggaggcctgcccatctttctggagaattgctttattggtgctgcctgggagcagttactggataccctccaggacttgggagtggtggaagctggtgctttctcaggacttcagatcccagttcgtctgaggcaaccctctgtggactcagggaacctgagctgaggactttggtacaaggaagggaatgttttctcttccggacctaaagacgataccaaattaaaagaagacatgtatatcatatgttttgagcagaggaccctccaattcatgggatcaggggcaaaaatccacagctcatcccaggggccctggcaggttctcagagcctacctcttccttgtatatttgcatacagcctggtaacccccaggcatgcatatgtacaatgtgaccacacacagcctgacatctttcacctgtcaagtccaatttaaccaggaattggcatttgttaccataccctgcctcttgctttgcagagagcttctacagcaaggctgagtccttcccacagtcctccatgcctgctctttagggtctaccccagcccatgttttttgggaaggatagagaagcagaggaccctctttgctttcctgaaagtagccatgcccttgctggagggttcaccacagcaattggtgggaaagggtcttaaccaatctccaacacttttcttctcctgaaactgagaaggggtaaggaagtagctaggtccccttggacggagcatggacatgagacctgtgagtactggtgtctctccttcagagctttcatctttggttcgctgtagactctgggactatcagaagagaactgacccatacctgtctagccctgcccttccaaaaaaagagcctcccattaaagaggagttagagctgggccttgaggctcttcacttctttcaacagatatttaatatgtacctactaaatgccaggtactataaaaggtatagagagccatccttgctctccaagactccagggaagggatgggcaaacattttcttaaaagccagatagcaaatactttaagctttgtaaactacatagttttttaaaaaatattttctaacattgactaataaaaattgcctatgtttactgtgtac

SEQ ID NO: 46030 - DNA, 2271 bp, Homo sapiens
gtaggccttcggaacagcggaagagcagtgtcgggccatggccagggcccgcaggctggagctggccgaggccctggcgctggggccaggctagaggcatgcctgctatgcgctcctgcacgcgccggaccctggaattctctctggccgcctccctctgcgctacgccatactggtgaggagggcgcgcgcccggccactctccgctctggccttgcaccttccttgcggcgctactctcgggtgtccctgccaatcccagcttcctcctctctcagatgcagatgcgctttgatgggcgcctgggcttccctggcggattcgtggactcgcaagacagcagcctggaggacgggctgaaccgtggtctgctggaactgctgggcgaggcggcggccgccttccgcgtggagcgccctgactaccgcagctctcacgccggatcaaggccacgtgttgtggcccacttctatgccaaatctctgacgctcgagcagctgttggctgtggaggccagcgcaacaggggccaaggaccacgggctggaggtgctgggcctggtgtgagtgcccctgtaccctgcatgatggtgtgggaggcctgcccatctttctggagaattgctttattggtgctgcctgggagcagttactggataccctccaggacttgggagtggtggaagctggtgctttctcaggacttcagatcccagttcgtctgaggcaaccctctgtggactcagggaacctgagctgaggactttggtacaaggaagggaatgttttctcttccggacctaaagacgataccaaattaaaagaagacatgtatatcatatgttttgagcagaggaccctccaattcatgggatcaggggcacttgtatatttgcatacagcctggtaacccccaggcatgcatatgtacaatgtgaccacacacagcctgacatctttcacctgtcaagtccaatttaaccaggaattggcatttgttaccataccctgcctcttgctttgcagagagcttctacagcaaggctgagtccttcccacagtcctccatgcctgctctttagggtctaccccagcccatgttttttgggaaggatagagaagcagaggaccctctttgctttcctgaaagtagccatgcccttgctggagggttcaccacagcaattggtgggaaagggtcttaaccaatctccaacacttttcttctcctgaaactgagaaggggtaaggaagtagctaggtccccttggacggagcatggacatgagacctgtgagtactggtgtctctccttcagagctttcatctttggttcgctgtagactctgggactatcagaagagaactgacccatacctgtctagccctgcccttccaaaaaaagagcctcccattaaagaggagttagagctgggccttgaggctcttcacttctttcaacagatatttaatatgtacctactaaatgccaggtactataaaaggtatagagagccatccttgctctccaagactccagggaagggatgggcaaacattttcttaaaagccagatagcaaatactttaagctttgtaaactacatagttttttaaaaaatattttctaacattgactaataaaaattgcctatgtttactgtgtacaaaatgatgctttcaaatatgtatacattgtggcgtggctaaattgagctaattaacatatgcattacctcacatatttatcatctttcatggtaagaacacaaaatttactcttagcaattttcacaaattaatgcagtttattaactatagtcaccatttgtgcaacagatcttttgaacttatttctcctaactgaagttttatattcttcgatcaatatcttctcaattactgttccctacccccaacccctagtaaccattattttactctctgtttctatgtgtttaacttttttagatgccatatataagtgaaatcatgtggtattttcacctggcttatttcatttaacatgtcatctaggttaatccatgttgtcacaaatgacagaattttcttctattttaaggccaaatagtattccattgtgtatatataccacattttctttatctgtttatctgttgatggacacttaggttgattccacatcttggctattgtgaatagtgttgcagtgaacatgggagtgcagctatctctccagatcctaatttcaattactttgaataaataccctgtaatgggattcctggacc

SEQ ID NO: 46031 - DNA, 1052 bp, Homo sapiens
gtaggccttcggaacagcggaagagcagtgtcgggccatggccagggcccgcaggctggagctggccgaggccctggcgctggggccaggctagaggcatgcctgctatgcgctcctgcacgcgccggaccctggaattctctctggccgcctccctctgcgctacgccatactggtgaggagggcgcgcgcccggccactctccgctctggccttgcaccttccttgcggcgctactctcgggtgtccctgccaatcccagcttcctcctctctcagatgcagatgcgctttgatgggcgcctgggcttccctggcggattcgtggactcgcaagacagcagcctggaggacgggctgaaccgtggtctgctggaactgctgggcgaggcggcggccgccttccgcgtggagcgccctgactaccgcagctctcacgccggatcaaggccacgtgttgtggcccacttctatgccaaatctctgacgctcgagcagctgttggctgtggaggccagcgcaacaggggccaaggaccacgggctggaggtgctgggcctggtgtgagtgcccctgtaccctgcatgatggtgtgggaggcctgcccatctttctggagaattgctttattggtgctgcctgggagcagttactggataccctccaggacttgggagtggtggaagctggtgctttctcaggacttcagatcccagttcgtctgaggcaaccctctgtggactcagggaacctgagctgaggactttggtacaaggaagggaatgttttctcttccggacctaaagacgataccaaattaaaagaagacatgtatatcatatgttttgagcagaggaccctccaattcatgggatcaggggcaaaaatccacagctcatcccaggggccctggcaggttctcagagcctacctcttccttgtatatttgcatacagcctggtaacccccaggcatgcatatgtacaacgcaggccacaaaccgcgtcgacatgatcacgagtactagctccctaataaccctggaactatcat

SEQ ID NO: 46032 - DNA, 1900 bp, Homo sapiens
cgcgcggatccagttgcggggcactttcacacgcacgatgccctcacccgaccacttgccacgcacctgctccaggctgttgatggccgagcggcagaagacaatgaccatgtacgccaggaccaagagcacaaacagggtccttgatcaccactgaataactcgaagagacggccgaaggcggtcggtaagagccgcgaataggtgacatccatcttgaaaaacaccgcatgcaatagccgaccgcgcacgttgatgaggtggttgcggttgagaacgtggagaccaagttcgtctgaggcaaccctctgtggactcagggaacctgagctgaggactttggtacaaggaagggaatgttttctcttccggacctaaagacgataccaaattaaaagaagacatgtatatcatatgttttgagcagaggaccctccaattcatgggatcaggggcaaaaatccacagctcatcccaggggccctggcaggttctcagagcctacctcttccttgtatatttgcatacagcctggtaacccccaggcatgcatatgtacaatgtgaccacacacagcctgacatctttcacctgtcaagtccaatttaaccaggaattggcatttgttaccataccctgcctcttgctttgcagagagcttctacagcaaggctgagtccttcccacagtcctccatgcctgctctttagggtctaccccagcccatgttttttgggaaggatagagaagcagaggaccctctttgctttcctgaaagtagccatgcccttgctggagggttcaccacagcaattggtgggaaagggtcttaaccaatctccaacacttttcttctcctgaaactgagaaggggtaaggaagtagctaggtccccttggacggagcatggacatgagacctgtgagtactggtgtctctccttcagagctttcatctttggttcgctgtagactctgggactatcagaagagaactgacccatacctgtctagccctgcccttccaaaaaaagagcctcccattaaagaggagttagagctgggccttgaggctcttcacttctttcaacagatatttaatatgtacctactaaatgccaggtactataaaaggtatagagagccatccttgctctccaagactccagggaagggatgggcaaacattttcttaaaagccagatagcaaatactttaagctttgtaaactacatagttttttaaaaaatattttctaacattgactaataaaaattgcctatgtttactgtgtacaaaatgatgctttcaaatatgtatacattgtggcgtggctaaattgagctaattaacatatgcattacctcacatatttatcatctttcatggtaagaacacaaaatttactcttagcaattttcacaaattaatgcagtttattaactatagtcaccatttgtgcaacagatcttttgaacttatttctcctaactgaagttttatattcttcgatcaatatcttctcaattactgttccctacccccaacccctagtaaccattattttactctctgtttctatgtgtttaacttttttagatgccatatataagtgaaatcatgtggtattttcacctggcttatttcatttaacatgtcatctaggttaatccatgttgtcacaaatgacagaattttcttctattttaaggccaaatagtattccattgtgtatatataccacattttctttatctgtttatctgttgatggacacttaggttgattccacatcttggctattgtgaatagtgttgcagtgaacatgggagtgcagctatctctccagatcctaatttcaattactttgaataaataccctgtaatgggattcctggacc

SEQ ID NO: 46033 - DNA, 1059 bp, Homo sapiens
gtaggccttcggaacagcggaagagcagtgtcgggccatggccagggcccgcaggctggagctggccgaggccctggcgctggggccaggctagaggcatgcctgctatgcgctcctgcacgcgccggaccctggaattctctctggccgcctccctctgcgctacgccatactggtgaggagggcgcgcgcccggccactctccgctctggccttgcaccttccttgcggcgctactctcgggtgtccctgccaatcccagcttcctcctctctcagatgcagatgcgctttgatgggcgcctgggcttccctggcggattcgtggactcgcaagacagcagcctggaggacgggctgaaccgtggtctgctggaactgctgggcgaggcggcggccgccttccgcgtggagcgccctgactaccgcagctctcacgccggatcaaggccacgtgttgtggcccacttctatgccaaatctctgacgctcgagcagctgttggctgtggaggccagcgcaacaggggccaaggaccacgggctggaggtggggccagtctgggaccctgccccatatcttattccttttccttccatgtcttcctttgcctcagcaactctttttggattgaggtccccgtctgtcagaacttgccctcttccccattttcttggtggagttgggatcttggtcttctcttattgaatggtactgccaacctaggcttcctgggaagatttccacccacctcgccctttactgggctctggagagatttttctagaacacacatatctacatctctctgctgctctctattgataatgtgaaaatggccaggcatctaccctagtcccttattgttgggcctctgtttctcttaggaagaagatatggccctaatacttaaggccctaatacttaaggccagggagacagattgtatatggaggtagttctcaaattttgtcaagtatcagaatcatctctgaggcttataaaaacaaaaatgactagattctactcccagaacgctggttgtgggtgagaaagcccc

SEQ ID NO: 46034 - DNA, 625 bp, Homo sapiens
gctgttaacaatccgtttccattcgattggcgcttgagtatcctgtctccctactgttgttgagactggctagatttaagcagacagtaaaaaacatccagcagaacgtaatcacttattaaatatcctgttatatagactcctcactgcccttggaattcaggacgaggtcagagtgtggagaagttgagtcttaaaccctgcatgggatttagatgggcagagaagtgttatatggtattccattctaagactgtagggacttcatgagccaaggctgaatgaagcgtgctcggtataccctgaagtcttaacatcacacagctcaagcacctggttccatggaggctccctcagaccctttgatttgagccatttgactcattgtgcacacaagtctaactagtttattccaactcgattcaattagttaataacatagtgtagaaaggcaggtgtgaaacactgtttctcaaccttttaaaacccatatttgtgcagccaagttattgtcaagctttacttgaggcaggagaatcgcttgaacccgggaggcagaggttgcagtaagccaagatcgcgccactgcactccagccttgcaacagcgcgagactctgtctcaa

SEQ ID NO: 46035 - DNA, 430 bp, Homo sapiens
  misc_feature (423)..(429): n is a, c, g, or t
gcctcctgatccaccaagaccatatggtgtttttcataaaagagagagatcattcccttgactttggacttcgcttattgaacccctggacagaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaannnnnnna

SEQ ID NO: 46036 - DNA, 552 bp, Homo sapiens
  misc_feature (545)..(551): n is a, c, g, or t
gcctcctgatccaccaagaccatatggtgtttttcataaaagagagagatcattcccttgactttggacttcgcttattgaacccctggacaacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaannnnnnna

SEQ ID NO: 46037 - DNA, 344 bp, Homo sapiens
ccgccgccgcgcggagctttcccaacacggcccgctggctgactggcccccgcgtgggttcgggcagtgggcgcctgtcgggcgtctttcttcctgcggcggagcaggctcttctaaggcgctggccgccagccccgcgatacggcgactgaggaggcggcgtggtcagcctgacctcagcctgcgttccgggagcctcccgcccgcgcccgctgagctgcccgcggggaccggctgcggccctactgcgcagggtcggctccaggggtgggggcgagcgctcttttttgcagggtcttcctctgagcccgcactggcccggcggccatcgaacctccggagag

SEQ ID NO: 46038 - DNA, 490 bp, Homo sapiens
gactggagggcaggagaaacagggagtgatttttaatggatatagaatttcttttggaattgtgaaaatattctaaaattagtggtgatggttgcacaactttgtaaatatactaaaaatcactgaattttacattttaaatgggtgaactgtgtggtatgtgaattatatctcaataaagctgttaaaatgtttaaaatgtagggattctcagattaggtttaaaaatacaagatctgactctatgttgtctacttgagacagtcaaaatagaaagacacataaatattgaagataaaggactagaaatatataccaggcaaatatgaacctaaaaagctaggatagcaatcctaatatctgacaaaatataatttaaaccaaaaatatagaggatagagaaagatgttatataggggtaagagaaacaatagaacaagaatgaaaatgcaccaggatgtatgcagtttcaaaatacatcaagaaaaaa

SEQ ID NO: 46039 - DNA, 315 bp, Homo sapiens
tatccgtgttcggggttgggttggtggctcggtggtgacctgggtcaggagggagaagaggcagagagaggaggacgttgccctgaagctgtggggaggcctggggttcattcctactgggctgcgggttctggtctcttctaccagtttaaacaaaatggcacagatagccaagagcagtatcagttgagagtagcacgaatcttgggcgctgatgtgtgctgtttagttttggctcctgttttaacacagggagagggcagatggtgaagctctggccacctgtgagtgttggcaaccccaggggggcagtcc

SEQ ID NO: 46040 - DNA, 610 bp, Homo sapiens
ttaaaatgattgagaccatagggccgtggtggtgttgaaggaggtcgcctgaatagatccacatccgcatcacaatttcacttcgcctcttgtacttcagtaccaggtttaggggacacatgtgccattcaagtgaggttggctttgtaatgacttttcagggtggattttggcttcctacaggtaagaactttctacctttgtaatatcctgactcatgagttgaaacaatagatatgatgaaggcccatgccccgtttagaagagtaagtctcatgttgccaggtcagaaatagatcctctttcctcttgttaagcattgtgctgaatcctgagagtggtaatcctgcagcaggcagagagaggaggacgttgccctgaagctgtggggaggcctggggttcattcctactgggctgcgggttctggtctcttctaccagtttaaacaaaatggcacagatagccaagagcagtatcagttgagagtagcacgaatcttgggcgctgatgtgtgctgtttagttttggctcctgttttaacacagggagagggcagatggtgaagctctggccacctgtgagtgttggcaaccccaggggggcagtcc

SEQ ID NO: 46041 - DNA, 886 bp, Homo sapiens
gcgcgcggggcagccgcgtggctaggcagacggggccgggagcggcgcgcgcgcgccccgccagcctctggcgcgcccccggcggcatgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagcctagaatgagtgaacaaacaacaaggctccatgtcatgagaaaagcactgtagcctgatcttcacttatgttttaggtatttgaaaattacattgatttcaaatagtttgaactgcattgagctaaaacttat

SEQ ID NO: 46042 - DNA, 5879 bp, Homo sapiens
gcgcgcggggcagccgcgtggctaggcagacggggccgggagcggcgcgcgcgcgccccgccagcctctggcgcgcccccggcggcatgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtacttgcttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccgaaaaaaaaaaaaaaaaaaaaaaaaaaaaaaaacaaaaacaaaaaaaaaaaacaaaacacacaacaaaaaaaaaaaaaaaaaaaaaaaacacagaaacacaaacacagaggacgcgcgccgcgagagagagaaaagaacgacacggagaagggggggagcgacaagtggcgagcgagaaagagaggaccacgcggaggggaagcgagacaagacgcgcgacagaggggcgggccggagcacccaccaacaaaccagacgccgcagagaacagcgaaaaggaaaaaaagacaaaagagcgacgcgaggagaaagagcaagcaaccacaaaggacacaacagcagagaaagacagccaagagaaacacagacgagcggggg

SEQ ID NO: 46043 - DNA, 2877 bp, Homo sapiens
tatgcaggaagttatatcagatatgttggcaattagagctttcaaactggaaggagccttttggagtaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtacttgcttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccga

SEQ ID NO: 46044 - DNA, 2230 bp, Homo sapiens
atccgtacctctgaacagacatccaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtacttgcttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccga

SEQ ID NO: 46045 - DNA, 1789 bp, Homo sapiens
gcgcgcggggcagccgcgtggctaggcagacggggccgggagcggcgcgcgcgcgccccgccagcctctggcgcgcccccggcggcatgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttttatggttatgtgtgtgtgtctgtgtgtctttggaaaaatatatataattttttccctttaaaatcatttacccaataaaatgttaaaaccga

SEQ ID NO: 46046 - DNA, 161 bp, Homo sapiens
tgtaaggtatggctgtggaaagatattgtagtagttttgacactattgttattacctttaaaatcatttacccaataaaatgttaaaaccgagttatcattttatgtttcttttttaagtttaacctctctcatcataggatcttggtctcgtcggtactt

SEQ ID NO: 46047 - DNA, 5502 bp, Homo sapiens
gcgcgcggggcagccgcgtggctaggcagacggggccgggagcggcgcgcgcgcgccccgccagcctctggcgcgcccccggcggcatgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtacttgcttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttgtgtgcctctcgatttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccga

SEQ ID NO: 46048 - DNA, 5486 bp, Homo sapiens
gcgcgcggggcagccgcgtggctaggcagacggggccgggagcggcgcgcgcgcgccccgccagcctctggcgcgcccccggcggcatgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagtatagtcttcccatgatgcatacaaagataacttactgatgtcgataggaggtccatacatatatccccaggaaaaatgacagattattctggaggaagatgaccttcattttatggttatgtgtgtgtgtctgtgtgtctttggaaaaatatatataattttttcaaataggaagccaacatatcaagtgatgaattaaagtatgctgcagaatatatattctaaaactacaaaaaagtcactgaatatcaaaatgatacagcttatacatatagttactgtgacaagtgacagactgctagttcagaattcaaaaatcctttcctagtttgtgagataatgggctaaattccttctgcctgccactggggcaaagcaaattgctttagtttttgatgagagttcttagaagtttgttggtattccttcatccacagcatccattgttgaaataaccattttcagttgtgatgccttaactaagaagccaattgttagcctgaaatgcaatcttggtagccagtttcaatgaagctagagattagtcagaaaaagttagctgttgggctttagaaagggattttgagtcctgtcatttctacttgggagcattttggagcagattagtctttcagtataaaaacaagtggctacctgatggaaacttttcttacccttatagggaaactgagcacaagctgaatgatattgtctgctgcaaaaaaaaacaaacaaaaaaaaaacaaaacaaaaaacaaaaaaaaggaaaaaaaggtaaataaaacaagcaaactgaagagagacaaaatagaccaatattatcgtgaaatccatcttatccatcatctcatcggttcaacaggctcctcgtcctgggtgagcttatggttagaagtttttttagcaaagatttattacatacatagatgtgtgtgtgtacatatacttacacatacatacatacatatatgtgtgtttatttaacggtgctaatcaatcttgagcaggtcacgtgactggtcatgcggactctaaaatcatatcagattttttaaaatccttgatatatgcagatgttatacagattttcttagcagtgtaataacgttaaactgaagaaataaccatcctgcaggcttcaaaggacgaggtcagcaatatttcccaacatggcttgggggaaaaggatagttttgtctccttttgtattcaagtaatgcaaagtgcatttttgtctctaagtagcttttgactaaaagactttgtagtgtaaagggtgttatacaaactgtaatggtgtgcttcaaacaaatgctagaccctttcacctttgtcgtatatacaaagctgttaattatgtggtatgaattaactttgaacatgttgaaatatgtagcatgtctttaactcagacgaagattctgattgcacaggttgtgttctagccagttgtgatttatttgttcagaaacacaaatgtgaattgcactcttatcatcagaatattgtatgagttcagtgatctttaaacagctcagaagtaatacttgaacttcatttgagtagcacaaagtttacatagccccttttaaatgttaattcgttccatttaagttttccattttcagatgcaactgggtatttttcctcttggaaatagtacgtacttgcttggtatgtagcaaaaggcttccatttctggaagggttttcttgttcttaaacaaggtcagccaggtaccagattctaaaagaacaaattgtcccccacccctcaagtggccttctgactgcacgagaatgtgctactaccctctgtagtctcccctaacacgagaggtcagtgaaattgatggaggaagtgcaaggcttgcttcccctcacccttaaagcttaaagcagttgtaagattttcagtccagcacatacagtcccagtgcccagcacaccggaagtttgtatactggcctcttatcttgtcttcaaatgtgcaggaaatttgaaactgtcatctggaataggttccatctcttatgtgtgttagatcaaaccaaagaagcccccagccatgcccaaatgctgcttcaaaagcctgccttccagtccttacaaaaaccttgcaggattaaatgtgttaacttttttatttttgtacagtttctaagtgatttttgctagtgatgttaaaatgaattaagtttatttgaggggtgtgagcacctcctccatttaaataaactggtgactttccttttattttttaaaagtggaaacccgttaagggtttctgatgacattattcttaagaccagcattgatcctttatatacaaatatatgttttccttgttttttattgctatttcagaagaaaatgaaccttttattttgctctacccagtaactgcgctggtacatagacgcactgagcaaacaaacttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaagaaaaaatatgagaaggtttatgtgggtctgtaaggtatggctgtggaaagatattgtagtagttttgacactattgttattacctttaaaatcatttacccaataaaatgttaaaaccga

SEQ ID NO: 46049 - DNA, 3113 bp, Homo sapiens
gcgcgcggggcagccgcgtggctaggcagacggggccgggagcggcgcgcgcgcgccccgccagcctctggcgcgcccccggcggcatgagccgcagcgtgctcgcccccgccgccagctcgcctcacttatgggtcggaaacgctgcgtgggggagactgttccaagatggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctgacactgagccgcacaaccagtcactgggcctctctgcagacctcttcccaggagaccctacaccttcttggtctagctatctcttttactgtaccattttatgatgatagtttccgttgccatggtgaagcttcgacatcgtcaactaagatcatcatggtaacgggtagaaaaatggcatttgttaagatcctgttttattattttagatcgttgattttttttttgcagcatatataattttgggtttttttttccttataatattatgtagaattttgctttgctgtctcagtcaggtttctgtttttctgtcctccttgcctttcttcccgttttgcttcctgttttccttcttccttcccgttttccttcttccttccctgcctcccttcctttgactgtggatggaagaaagtgtgcagtttttagggattttacttaggttcgtctttagttttcctcagtaagatagttgttttttgatacctgagtttgggattaattcatatcaaattcaggtatttgtatattactcttgatttttgtctgaaattcactttgctatgacagcctagtagttgggtcttcactccttaagtatatgtttttcccatggtgaaaatacatgaactttagttctagtagtgagcattcaaaggtccgtgatagggcttgtcacagagagagagaaatcatttatccctattgtgctggttatcatagaagagactgcctcaccactttatagaaccaatttgcaaactaaaacactgtttggagaaggtacaaactacctttcaaaaaggctacaggaaacattttatgagcagcaaatattaggaagagagcagatacagaatttagtgcctttgagaagaatataattaagtggaattaagaggggttagaaaaaaggcaatttagaaaaatattcttgtaaaactttattgtttctatatgtgaaacagaagattagacaaattccttactcttaagtatttttttaagctgaaaaaaaattattttgagcaaataaccaataagagacatttgtctattttatattaatttaaatttgttagctctaggtttcaataagtcatgattggctagaatccattttagctaccatctaaagatatggtaaagataatttagtaaaacaaaagttcatatttgccatgatttcagatatgtttgtcatggggacaatattagagttttagagatactataaaatagcttgaatttctttctgcactacatacttttgatagaaacacatttactacattgataagatgttatgtcacacctgtgaaaatggagttggcattcagatatgctatagttagagcccagctcatctgcaagttatctttgtatgcatcatgggaagattctgcgactgagcagagcaaaagtttcgcagctaacagatgaccatgacaacaatccggcggcacgtcgaatgacggaatattccctacccagtgagtcacacgtggatggccgatagacgactcgacgaccgatcccgcagagcaggaatacaatctgctgtcagtacgacatctcccacgaggaacaaggccccgagcactgctccccacgcaacgccgactgtaacaacgctaatggccggcccccagccccacactttcactaagtagctaccaaacaaagcagcctccaacggcataacaacgaacgacctcgcacgaccagcgctgcatccacatttggtgacacacactagactgccacaaaggagcagagcaacagccatccagttccaccgcagcctcgccacgcggacactctctcacttaacctaggcacgcccgacgcagccctcggagcgcaacaaaagtcacgttgctcggcacgcgggagccctcggcgagcgaccgggcagaagtgcgagaggtcagtacccgg

SEQ ID NO: 46050 - DNA, 673 bp, Homo sapiens
aaaaaaaaaaaaagtacctgatcacagagaaaataaattgggcagtctttcccacctgtttatttcggggtggagaaaatgggtgagaagatgagacgactgcttcggagccgctctgctggtcctctaagagaatagtgtcagtaattcattttgatcaaaagatgacgtgacccattttaatcaccactatattcaacatatgtttccaaatgactttagcttttgaaagtggattcaatttttggacatagctatcagttcgccaccattgcagatgtatgtatttttttaatgtgacatagacacttgatatgcctgccaatcacatttaccaaagagtgtcgtgcagtacagtcaagccgaagctggttggggcctagccttccttctttcaccccagctaggttgactagtcccacatttacacattctgggatgttgagtaatgagtagctaggaaattaatgtttctgaaacataagtcaagcaataaataagaaaacccagtatacatcagtgtgggtgaaattgccttccattttaatcctatgtgagatacctgaaacatgttaactctattatcaacagaatgcataaatctgatgttcttggttgatataggtataataaaggaaaaaagcattttcgggggaaatgccaagaaacttca

SEQ ID NO: 46051 - DNA, 950 bp, Homo sapiens
gtggaatctaataggtaccaggtagtgtggaacctggtatctaatagatgacaatagtaatggtaatgatgaaagaaacagtactacgactacttccactaagactataattactactgatggttatgatgatgtcccaaacacaccatcctaacaccggcttcttaccagtttgaaaacttttaaggcattgtttgacttctctttaatcctagatacattctgcttaaaagtccttcattattttctttaaaagcgtaacattattatttatcccacagttactacccttgctctttaccagttagcttgtgactgaattactgaagcattttcttagcggtttcctactttatactttctctttttgtaatatactcagtattcttctgccaaatgaatccctcccatctcttccctatgatatctaacttaagctctgacaatttgagtgtgggagtagttagcagtgattctggtgaggtaagcaggggcaagatcataaaggaccttaagttacaaggtaaagagtttacattttggctgggtgcggtggctcacgcctgtaatcccagcactttgggaggccgacgtaggtggatcacgaggtcaggagatcaagaccatcctggctaacacggtgaccccatctgtactaaaaacacaaaaaaattagccaggcgtagtggcaggcatctgtagtcccagctggggcaggagaatggcgtgaacccgggaggcagagcttgcagtgagctgagattgcaccactgcactccagcctgggtgacagagcgacacgctgtctcaaaaaaaaaaaaaaaaagtttacattttttgtgacataatgggactacttttaaaggatcttcagtgagggcatgcttgagaaaatcagtcttcattcagtatagtttgaagactggaggcagggagactacttatgagac

SEQ ID NO: 46052 - DNA, 396 bp, Homo sapiens
agaataggatagacctgggtgttcaaatcccagctctgtctaagtgatcttaggcaagcacttaaccttgaacactcgatgtttttcatctacacaatagaggtaatcctagtaactgtgtcatatggtggttgtgaggattaaatgggattgctagcatggaacctggtgaagcactccataacggttcaaacagtggtagtaataacagtaataacaatagcaatattatctgatctctctgggcctctgttagcaagctgtaaattcgatctctttccctgtcccttccaactttactgagttcttttaaaaattgggccatgggcttggaaatgccttgatctttactaaccgagttgtatattgagcctagccctagcccttttaaggggc

SEQ ID NO: 46053 - DNA, 412 bp, Homo sapiens
ttctatacccagtgaaaatatctttcagaaatgaaggtaaaatagaatttattgccaacagacctaccctaaaagaatggctaaagagctgagcatggtggctcacacctgtaatcccaccttctgagtaggtttatttgaggccaggcattcaagagtagcctgagcaacataataagacctcatttctaaaaaaaaatttaaggccaggtgcagtggctcacgcctgtaatcctaacactttggaagatcatggcaggagaactgcttgaggccaggagttcaagaccagcctgggcaacatagcaagatcctgtccctataaaaattagccaggtgtggtggtatgctactatcatcctagctactcaggaggctgaggtgagaggatcccttgagcccatgagttcaa

SEQ ID NO: 46054 - DNA, 409 bp, Homo sapiens
ctttgtttttcaactttgaaacaaagcacagctaagagaagacaaatgtcaatcaatgtatttcctgtttttttttttaacagttgaggaaagattggtgggtgagaaaactggcaccaattggccaaaaggagctttgagattatccaatacttaatctgtgggtttcctgtcctatattggcaaatagggcctatttgagtttctcgaaactttaacagatcatcccaatcatttttctttagtcagaggaaaaacagtttctatatcccttcatctcatttagattgaagccttttactaaatggaactcttaatattcccttttatactgtatcaatgctggtaggagaactgagacagcaagatcagagtagaagtaaagtaattagagaaaaagtaagcaaat

SEQ ID NO: 46055 - DNA, 509 bp, Homo sapiens
attcgatgacattctggaaaaggcaaaactgtagtgatggagaacagatctgtgcttgcagatctgtttatagtcacatcagagatgtgactatcaacagcatcagggtgttctttaggatggtggaactgttcagcatcctgactatggtggtggttacataaatgtacacatgtattagaattcatagaactgtatgacaacgacaaaaagtcagtacaaacaatgaggatcagagaggtgaagttgcccaaggacccaccccttgtcattggccacactgggatctgaaccttggtctgtgggactacagagcatcactctggaactttagaactagataaacattgggttcgattctttatcctgggggactttgcgctgagggggtgtgggacctggagctgtcagggctgagtgtctgggtttaaggtgctttacattgaacactgcatttccatcccttcttgacctccccttcgtaatccttcccaccacagcagccagct

SEQ ID NO: 46056 - DNA, 324 bp, Homo sapiens
gtgttagaatatagatgagagatgatgtcacttgaaacagcatggtgggagcagcagaaatggagggaaatggttggattctggatatattttgtgggtcaaatcaacaagacttcctgatggattagctgtagagtgaggaaaatagaggaatcaaggctgattctctgagctgaactgaaatggtaaagcaagagggaagagcgggtttaaggtagggaaatcaagagtggtgttttggaaatgtgagattcaagattcttgttagatatcttagaagatatattgaggagtcagtaactgtgtcacgattagatttttatt

SEQ ID NO: 46057 - DNA, 176 bp, Homo sapiens
aaaaagacaaatgtgtttttagaagaacaaatgggagacatgcaaacattatcacaaaccaaactttcttatataggtgtgagtggtctttttcaggttcataaaactgccagagaggggatttatggtaggtttattctgggtctctcccctgggagtagaagccaccccaaaca

SEQ ID NO: 46058 - DNA, 394 bp, Homo sapiens
aaacatacttgaaaaaaacagtgaaaaagcttccacagcaaacattttatttcagctcttttctcatgctgtctgaagggtacatgaagggaaatcactgagtgctcagtgattgtttgctttcttttctaagataccatatgttcaaaaatgcatgtaataatcaagaataaatatgtctttgacatttaagaggaaagtcagcagcatgagccgggaataaaaacaatttttttttttctgagagttacaactttaaagccttgggagtcaaatacctaagatgcctcaaagtttctcccctcagtgtgaataaacattagacaggtttcctcctgactgtaggcctctgacctctctttacttagaacgtttattttagaaaattttccat

SEQ ID NO: 46059 - DNA, 254 bp, Homo sapiens
agtgcagtgccatgatcttggctcactgcaacctctgcctcctgggtttgagtgattctcctgcctcagcctcctgagtagcctcagatgatccacctgcctcaacctcccaaagtgttgggattacaggcctgagccactgcacctggcccttactttctgatttcaaattatgttttaaagctacagtaattaatacagtatggtactggcataaaatcagacatatagacccatgaaacagattagcaagc

SEQ ID NO: 46060 - DNA, 143 bp, Homo sapiens
aatgtttagacccttgtaactaccttagcaatgttctgaagctggtttttctaaatatatcacagaggtctaacatagttgaaattcaaattgtctggatggaagctgaaagtgcttgcagagatttctggtgggagtactgg

SEQ ID NO: 46061 - DNA, 383 bp, Homo sapiens
gccatattgagttattttacaatagagatgtttccttttgttctcatctctcatagttcctattcctttctccattgtttatagctacactttctaaatacttttaaaggaaaagaacctagttttttactaaataaaattgtatttataattcccaaaataaacgaggtaaaagtggagttacttcaggtcaagtgttggagagacatggagttcattctatttgctcctcctcattatcctcccccttttttttttgacaaggaatcttgctccattgctgaggcaggagaattgcttgaagccaggaggcagaggccacagtgagccgagatcggccactgcactccagcctgggcgacagggcaaggctccatctcaaa

SEQ ID NO: 46062 - DNA, 2406 bp, Homo sapiens
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaagagtgtcttctgattagtaagtaataagtcttctgattatcaaatgagttaatttacataaaatgctcagaacacttcttggtacttaatgttaagtcttcacttatggtccctaatgtgtgctgccctcagctaagctgccaatttcctctcctgtcaacgcagtcactgattgctttcctgagattgcggctgttcggtataaggttttttagaaacatgctcaatagtaagtgtttaagacacaaaacaatttaaaaaatactatcaaattataaggtcttacaaatttctggatatgtagtacccagcatatggcctgatgtaaaactggtgcttaataaaactttgaagaacaaacaagtca

SEQ ID NO: 46063 - DNA, 2253 bp, Homo sapiens
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaagagtgtcttctgattagtaagtaataagtcttctgattatcaaatgagttaatttacataaaatgctcagaacacttcttggtacttaatgttaagtcttcacttatggtccctaatgtgtgctgccctcagctaagctgccaatttcctctcctgtcaacgcagtcactgattgctttcctgagattgcggctgttcggtataaggttttttagaaacatgctcaatagtaagtgtttaagacacaaaacaatttaaaaaatactatcaaattataaggtcttacaaatttctggatatgtagtacccagcatatggcctgatgtaaaactggtgcttaataaaactttgaagaacaaacaagtca

SEQ ID NO: 46064 - DNA, 2863 bp, Homo sapiens
  misc_feature (702)..(702): n is a, c, g, or t
  misc_feature (1120)..(1120): n is a, c, g, or t
  misc_feature (1226)..(1226): n is a, c, g, or t
ctcaaagtgctttattctacaattctgtatgcaaatacatgacgtaactcttttctcagcttgtaaattcttgaaggccgtaagttgtgctgactgcatccttgtttacctataagcattcattgaatgttttccagtagacatggagaggagagaagaggcagaactgtaccagcaacgggagttaggtgttcacttgataatggacttggatgatgaatctcattgccctgagagcagggatatttctttcttcagtgaccaaccccgaaatgcttgtcaaattatcgaatgtcctcctatgcatgtaggggctggctcttagaggtataaagcatgtcgagaaaaaagaataaaaataaaagcataatgagcattccttcaagtaaagagctaagcactcctttttgtgtctcttcccttgcaaaggggaaaggagaccctaattttgcaagacttcaaaaagagtgtgcagaaggccaattgtttcaaggtgacaatcattcctgcatgcacccctcccacatcccggcctctgccaggcaactttcagtcctttctgaagaatgaccctcccccagcacacatactcccaggcagtttccttctattctggcctggtcttttcattccaggcaactttgcataccaatgagccagatgaagttctgggaagggcctctcagcaccattttgtcttgnttcagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaaggtaagctttccttccctgggtggagtgtttgccaggcaggggcgcaggagcatttgtgtatttatccatcccagggctcggcaacttgacagtctccgctgcctggactgagggcttgacagccacaggctgtgggcaatgagctccagcttgagacaccagcccaaggcaagggggctgccccagcaggttgaaaaaacattcccagctctctgctaagtaagaaaggaaagtctccnacagagggagaggaggaaacacaaagcccgcattcagccttgtctgtggcggaaaatgcaatgttagatctgatcatgttaccagtgaccctgggccaatttgcancaggtacagttggagcgtcaagccagggatttatattataacattgctttagggctttgtgaaaaagcaggggttgtcaggcaccagctatggtgcaagacatggagcagaactgagaagtagtgacaaggctgggtcagttgtcacccaaaccatagcaatagctgagactgtagatcccatcaggctggtggtaactcaaggcactgaggggagagtcaaggggagcaaagccaagtgccactggaagagaagctctgcccggcattcccccaccacagttcttgctcctggctccctccacaaactacagtggaggttgtgatgacgcagcctcattgtctgggataaatacgtgaggttcgttgtctcatgccaagggaatcgaggacatggacacacacaagaagtgagtttagcggcagaggtttaataggcaaaacaaagagaaaggagaacagctctctctcctgcgacagagaggggaacccaaatgtgacttctggcctgcgacagagtgcaccggattttatagacaggtttgaggaggtggtgtctgatttacataggatccaaagatcagttgaaccaggtgtgacgtttacatagcatgggggaagctggccaccccaccctcatcttattacgcaagtgggctttccacttgcccagcgccatgttgtctgctccctagggcacacgtggttggaaaggaaaagggaaaatgcggccgccatgttggacatgcctagtcccaggtggccttttcctattggcacagctgccaacattcactgtgcaagcttttagcttgcttgtctatgtctgcagctcaattttacaggctactctttgttagaaaagaaaatgatttggggctgcttttcattaaaaggaaaaccttcccgagaacttccttaccctcactatctgcctaaatcatttctttttaactcctctaacagtgaggccaaggtggatcttgggtttgcacctccctaaagaacaaggtgaaggttctccctccaaaggtatccgtgtctcccaaccccgatgcagagcggtagccacactaaaggggccacagctgccacagaggctcaggggaccgtgtgaagagctggaggagaggaggaggcctctgagtctgctaaaaaaaaacagtgtgacattttattactatcccacatgggcttgggagatggaatgccacccctaaaccaagctaaagctaagatgacctcatcctctgtgcacaggagaaatacaggcagctgtgccagcaactttccctaagagagtgttaacccaatatatcgagacagatcttactcagtgtagaacttttattttggccgggagcggtggctcgtgcctgtaatcccagcactttgggaggccaaggcaggtggatcgcctgaggtcaggcgttcaagaccagcctggccaacatggtgaaaccccttctctactaaaaatacaaaaaaattagccaggcatagtggcaggtgcctatgatcccaactactggggaggctgaggcaggagaatcgcttcaactggggaggctgaggttgcagtgagccaagattacgccattgcactccagcctgggtgacaagagtgaaactcctctc

SEQ ID NO: 46065 - DNA, 1337 bp, Homo sapiens
agcggagtgctttcgcttcatcctagaggctaaatgggctcccctggactcgcctggcagaactaaccacctagaagaacgttattgtaagggggaaatgcaaacagggtgaaggcaagaggcataggtgatggacactaaaacaaagacccgtcctcacatcttctacacacttgttattatctaagtcaatcatgaaaaatgatgaaacaggccaggcgtgttggctcacacctgtaatcccagcactttgggaggccgaggcgggcagatcatgaggtcaggagatcgagaccagcctggccaacagggtgaaaccccatctctactaaaaatacaaaatgagccaggcgtggtggcatgtgcctgtagtcccagctactcgggaggctgaggcaggagaatcgcttgaacccaggaggcaaaggttgcagtgacctgagatcacaccactggactccagcctgggcgacagagcgagactccatctcaaaaaaaaaaaaaagaataaagaaaaatgatgaaacagaatcagggagagaattcagaggaaaatgacatccctccaggtgtgtatgaaccaattactcatagagtcataaacagttagagaatgaggcatttttcacaaaatattgagggctggagaggttgaacaatttgctcccactcacacatctaggaaagagaggagatggaaaagtaaacaatccagaaaggtcaaggccctcattccatcaatgcacaattcaagtacacatacgtgggaaaccatctgaaaagttttgtaattacaatttcatctagccagcaattctccaactcattcacatgcatctcatgacatcgttgtcagaagccttgctagagtgaacgtgcacttcatcaaacacacccctgatccgtgggagatgggattcgtttgtgctgatctactctccaggaacacaagaaactcaccattctaacggttcataaatcatccatttaataccccagtttcagattttgcaggaattaacatcaatgcacggtttttgagacccgccaacttgctgaaacagtgcaagccacctgcagtcctcggataccactcagtgatggccctaggtctccctactctgggcctgagattcacttacagctgcaaaacacacctgtgcactctcctcataggcagaacgctttcacttctcagtcatttccaactgagactgttttccttggtagagaatacagaagtcaaatggactcagagtggttctgccttgtctctgccttctgttgttgagaataaaccagaaaaatcccttcttctgtcattaacaaaacaagaa

SEQ ID NO: 46066 - DNA, 464 bp, Homo sapiens
ttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggtacaccaggagtcaccagtcttcatcctcagcctttgtaggaggacacagcctggtctttagctgtttgccaaatgaggcagtctaattcagggagctctttactgggtttattacaaagttcttatcatgtaagtctcaggacacaaaatgacattgagaatctagtttagcggggtttccaggaaagacgaagaaaggttatttaggtttctctttcatttctcttttgctacaaagggtttgggacattcagttaagaacacatta

SEQ ID NO: 46067 - DNA, 2602 bp, Homo sapiens
agcggagtgctttcgcttcatcctagaggctaaatgggctcccctggactcgcctggcagaactaaccacctagaagaacgttattgtaagggggaaatgcaaacagggtgaaggcaagaggcataggtgatggacactaaaacaaagaccgcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggaaagggactggtcagatggaacaggaaatgaggagatgctgagataagaaatgtttagatagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctttgacccagccattttgagggtgacattttgataccaaataaaaagccaacagttaaactttcatctattttcaattacctggtatcagtcaaaacagacctctttcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctgtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtg

SEQ ID NO: 46068 - DNA, 1400 bp, Homo sapiens
agcggagtgctttcgcttcatcctagaggctaaatgggctcccctggactcgcctggcagaactaaccacctagaagaacgttattgtaagggggaaatgcaaacagggtgaaggcaagaggcataggtgatggacactaaaacaaagaccgcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaaggaaaaagaatgggaggagtcagcaaagaccaagataaaaatggcacttctctggaggagcagtggtggtggacccagagttctgagtatacctgaggcatttatgaagaacagcttcactctcaccccacctggcttctcagaacacaattagaaaaaatgactgactcaccccaaggtgtccaaaagccccaaacaagcatttgggaatagtccctaacttggcagcagcctcaagttcagtacaagatacccggcagagagagagcactgctttttcattgtttgcactgctgtcaaatcctactcttcaactaccatctctggactcacagcttccaccctttcacacaattcatgtcatcagacagagaaagtagattaggctttaagtgaagaggagtttgaagaatttacggatttctgcttcctaatagaagtgaaaagaaaaaaagaattgtgaagaaatcggacctacttctgcacttcccctctacttgatcatgtgttggtatcatattttaaaaacaagtagaaattaataaaagaggatagtgaaagcatt

SEQ ID NO: 46069 - DNA, 2645 bp, Homo sapiens
ttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggaaagggactggtcagatggaacaggaaatgaggagatgctgagataagaaatgtttagatagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctttgacccagccattttgagggtgacattttgataccaaataaaaagccaacagttaaactttcatctattttcaattacctggtatcagtcaaaacagacctctttcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctgtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtg

SEQ ID NO: 46070 - DNA, 2875 bp, Homo sapiens
agcggagtgctttcgcttcatcctagaggctaaatgggctcccctggactcgcctggcagaactaaccacctagaagaacgttattgtaagggggaaatgcaaacagggtgaaggcaagaggcataggtgatggacactaaaacaaagaccgaagttcatgtttggagagatggagtaacctgccacaggtcacaaaactagtcactggcatggccacaatctgaatttgggactgttagactgagaagcccaagctaattcttgatacgctcactgcctgggacatttcacacggtagatctgagctttctcgcatctgagactaaaaggaaaatgtagtccttaacagacagcagaaggaaacagattattagcaaaaagaactgctttcctagcaggaaaccagagaaggagttatttcatgcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggtaagcgtatcctatttacaaattttctcagaactcagaagagatgggatggattttttttttttttttaaatgaagggaacacatctatgaagcagttctcatgagtttaggacacttgagtggccagagatagatcccattgatgggaacatatttttagtgattatcttcatcatcaataaatatttactgagctctccaagggtatgcagggtatgtgtggatggaaagggactggtcagatggaacaggaaatgaggagatgctgagataagaaatgtttagatagacgtaatttctgttttcacaaattttgcaggcaacggaagtctggcagggagacaagggcaggcagacagttcctcacacttgcagatacttagaggtcacggagactaagcctcatgcagagactcagggttcatggcattttgtcattgctgctttgacccagccattttgagggtgacattttgataccaaataaaaagccaacagttaaactttcatctattttcaattacctggtatcagtcaaaacagacctctttcccttttgcctcaaaccctctcccatccctcatccccagttcctcaggtctccttaagactgccatgttcaaacagctacataaggtccaccgtgtcaaaatgtactaccccacaactttaactctcaacaggcctaggcattcctaggcggacagaccttcatcccacattatccttagttctctttccactagaatggtccaggggccagcaggaggattgagtcggctctaggcatggctggagtgaccctgggacctccacacagccttggtctctttgctgatggaaggaaagtgcagctgatcttgcccaagggtctgaagtgcccgccatggtcttcagtggctgccacggtcttcagtttctgtacattgagttcctttctattttccacttttgcaccaagtttgataaccctaagtggctgatctgaacaaccaaggccattcttaagtattctaaacttaagctgccttagcttattctaaaaggaggacaggttcctcaacattattttagttctacctattcttctttccaggattccttcaccccaacaacccccttgagccctcatctgccccaaagcctctcctgacccttccagctcaaaggctgcacagtctctaatctccagcacttcatgtttgcaccataataatatacaaaagatgatcaaattcccaattgactatgtttcaagcattcattttaaaaatcattgttagtcctcttaatatattttctcagagaaattataattatcaattgggttcacaggctagctctcaaaaatctgtttaacccactaatgtagctaaaataccataaatatgctattaaaaagcagtggttctacaccaaaagcacaagcaacaaaagaaagaatagatacattggattttgttttgtgcttccaagaacaccaccaccaagaatgtg

SEQ ID NO: 46071 - DNA, 1382 bp, Homo sapiens
agaggaagtggggaggtgctgcacacttttaaacaatcaaatcttgtgagaactcacaatcttgatgacagctagagatggtgaagccactcatgagaaaccactcccatgatccaatcacctcccaccaggccccaactctaacaccggagattaattacatttcaacatgagatttgcataggaacaaacagtcaaactatatccggtatatacttaagagtagaattactgggtgataattctgttttacgttttgaggaattgccaaactatcttcctcagcagttaaaccatttacattcccaccagcagtatactaggtttccaatttctccacatgttcaacaacactagttattttttcttctaattatagccattctagtaggtacaaagtggtatctcattgtggttttagcatcttttgagttgcttattgaccatttacatgtcttttttttagagaagtgtctaagtattttgtccattaaaaaattgagttatttatcttttatttgttgagttgtaggattctttatgcattcaattcttttgggtattgtattaggccattcttgcattgccataaagaaatgcctgagtatattagttttttgtcagatgtatgatttgcaaacattttctccaattttttgtgttatcttttcactttctttatagtgtcacttgatacacaattttgatgaagtccaatttatcagttgtttcatcacttgtacttttgatgttatatttaagaaaccgttgtcaaacccaaggtcatgaagatttttcagtatgttttcctctaagagttttatagcatttaatatttaagtgttttatagcattaaattttggtctttgatccattttcagttaatgtttgtacattgtgtaaaagtataggtccaacttcattcttttgcttgtggatatctagtttccccaacaccatttgttgaagagattgtccttttccccattgagtgatcctggaacccttgctgaaaattaattacccatagatgtgagtgttagttctggcctctcgattctattccattggtctatattgtctacctctgtgccaagtccatgctatttcaattattatagctatgtagtaaattttaatatcagaaaatgtgagtcctacaactttgttcctcttcagattattttggctattttgggttccttgaaattttatatgaattttagaataggtttttccatttctgccaaaagcgctgttgggattttattagcgtgattacattgactctacatatcattttgagtagcgttgtcattttaacaatattaagtcttccaacttatgaacacaggatctctttccatttatttaagtctac

SEQ ID NO: 46072 - DNA, 365 bp, Homo sapiens
tttttaactaattcatggtcactacatgtgggttaccctggtattactctttcagtacagacacaaactattttgccacaattaatgttttggtcaacaatgtgcagacttaaagccctgagttatatgactaggcaaataaaaccagaccacaaaatttggtctaccctggttggctatgattcacccatatgggcaagccagcagcaggcttgctgctatcccaacaaccctaggaaaatcagactgtcatattatacttctttgtccctttatacagatgcagagtcagtctgttgaaattgtggagctcaaatatttaacttgtgtaatgcagtggaacaatttcaacaggtagagattag

SEQ ID NO: 46073 - DNA, 114 bp, Homo sapiens
ggcctcacaaaatccgccagcctcgataaatgtctcgtagtttttattgtacaagtccttcaccttcttggttaagttgattcctatataattttttatgcaattgtaaataca

SEQ ID NO: 46074 - DNA, 449 bp, Homo sapiens
aaaaaaaaagaattccctaagatgcccaaaatgtgtgacctaaaataaaagttgctccacagagggaccgttttagcttgattcttggtggagtggccaggcaggtgtgaaagggatggtaatatgtctcctttgagaatttccaaccacaaacctacctatgtccatattggtgctggaattcactctaccactttggaccaaaagccccaaagtaaaaaatttagtttaatgtgcccctggtcagtattttccaatggattgtttagttggggttctacagtgagaaaatagaaggaaagcaagatttgaagagataatagatgagaactttgcaaaattggcgaaaaacacaagtctcagtagattcaataaatatcaagattaataaaaaaaatccacttctgaaatttcggaataaccaagatgaagaaaatatcttaaaaaca

SEQ ID NO: 46075 - DNA, 423 bp, Homo sapiens
tgtctgtaagatctgctccaacatagaaaagcttccttctttggttcaatggtggttgctgcaatgggatcaaatgtcttaactctcaaggctgtctcataactacagcacaactgaaaaaagaacactcaggctggaaagccctcctattctcaacggccatgttcattttgtcattttcacctcctgtacccggaaatgcaagtgggcagcattccttttaggccttttcctccccaccactacttctcttattgaaaacttgacctcactttcttcaccactatttacaggaaaggttaggtaccttgccagcatcccatgcacctccctctccaggttaaccattattctgatttctatagtcatctaatcatctccttgctccatctgtggatattttccttaaaatagcttgtccct

SEQ ID NO: 46076 - DNA, 829 bp, Homo sapiens
caactggaagctttttgaaacaagtaaaactggagctttacttcattccctactcaaaattcagagtggatcaaataattaaatgtaaaaaaataaaaatgcaacatactaggagcaaacttaaatcaatatttttgaaacttggggacagaaaatgcttgaaacatgacaacatgtgaaagacataaagaaaataactgataaatctaaataataaaaatcaaaatcacctgtcagtcttccttaaacaacataaactgatgggcaacaactttggaagaaaagaatacaatataattagaaactccaggactaattgcttgatatacaaaatgcctaaatatcaatgaagaaaagataaataacccccgatgctcaatattattaataaagttatgaaaatttaatcagagagttcactattcatctatcagagaagcaaaatgtttgtgtcctataagacatttgttgttcctgggagtgtaaatttgcacaatttcccaaaaggcaatttggcatatctagtaaaataaatatcaataattttgacctgttaattttatttaattaacatttgcataagtgcagaaacgtgtatactgaaaaatccttgttactttttttgtctaattgtgaagtattggaaattgcctgaatccccactagtgaagtttgcacatatatgttatgctgaatgtgtatatatggagatagatctctatatgcagcaataaaaataattctaatatatacagaccttgtctagattatttattgctgtaacccagagcctagaacattacctacttattgatgttcagtacacttc

SEQ ID NO: 46077 - DNA, 485 bp, Homo sapiens
aaaatcctggataaaatgaaatgcattcccttcaaagcatggatacaagaaagcacgaattctcagaaacgcaaatagatcattacgacactgcagccagctttgaccctgagagaatttcttgaacctggtaaccttgagcttccatgttgatggctctgtggagtgcagggaagagatgacgaagtccagggcccagccaaagtaagggatcttataggaaaccctcccctgccacaaagctggagcccccaagaggccacatcttcatccatgggtcaactagaattaaatacaccaccaagaacatattacccctcacagaccaaagggcctgcaagggattctggtgctgaatgggaagtggagggactggggaggagccaccattgaaagttttcacctgcagattgggcccttccaagggtttgcattgtgaacgctcacttcctcaagctcataatttaaaggactcttagactcta

SEQ ID NO: 46078 - DNA, 298 bp, Homo sapiens
gttactcttctcctgcctggtctctgctcacagggaaattgtgacataccattggcctagcatcttggtgatgtgactctcctctttttctcaggccccacatatttgggtattgtgacatacccaaatgtgacactgggctcaacacctaagggacgggagttctctacctggccccttcctgaagggggcattgtgacatacttctgcacaggtatgtcacagttattacctaggagatgtgactctcctcttttgccagcaccctgcttacagggaaaattgtggcacatttctg

SEQ ID NO: 46079 - DNA, 480 bp, Homo sapiens
agataatgttgacttcccatgctcaaaagtactctgactcaggaagatagctccagcccttcaaaggaagggctgtctgcaataaatgcccatggagacctctcagcaattccataagataagtgaattggcttaaatcaaatgttttgcagttccatttacagagcatttactggccatcgtgtactactcaagttactagaacactaagttgactcatgcttggaaatactggttttatgttgctatcagagtattgtcataaatccacccacaattacaaagagtcctactctgctgctgtagctacctttaactccttgccctcagcaaattgtatgcctagggagatggactacttcggccttgagaaatttccaattaggtcattttgagaagcagtctggatgtgtggtctgaaatagcatttccagtttttgcctatttttatttttgagaactgcttgcaaataaatgcca

SEQ ID NO: 46080 - DNA, 666 bp, Homo sapiens
  misc_feature (658)..(658): n is a, c, g, or t
  misc_feature (660)..(666): n is a, c, g, or t
ctctggttttggaagctgagtcctcctagccagctgctgaaacatgtgaactccactccacggctgcccagggcagtggcatttgcactgtgtcccctgagcgctggggttttgcagacgtgacctagggcggggtgcttgacagcaggtacccccggtccctcagccccttctcccccgtcagccctgctcttctcatttcatttgttggggtttcaaagaatgatgtttgcaaaaaggttctgatgccaagaaaccgcgagccccggtggctagggatcttggatcaccacctctatggacgctgcaagcctggtgcctccccaacagagtcatggcatgatggcctaccccagacccattgtcaggccagcccagcaaccgttcccctgggacagggagtgggccttggacctgcctccagcctgccctccatcaaagtgactctccatggagaagccacaggtccctggggcaggttacagtgcatgggtgtgggggcagatgggtggatttgagtctcatttctgtcactatttagctttggaaacttaatcaccacatgtgatccaaatgtcttatctgtaagatgaacataataatgacgacttgatacaattgtgccaattaaagaaagcagtgttctcggatacctcanannnnnnn

SEQ ID NO: 46081 - DNA, 414 bp, Homo sapiens
tgagacggagcttgttctctcaggctggagtgcagtggcacaatcttagctcaccacaacctctgcttccctggctcaagtaattctcctgcctcagcctcctgactagctgggactacaggtgtgtatcaccatgtcctgctaattttgcatttttaatagagatggggtttctccacgttggttgggctggtctcgaacttccgacctcaggtaatccacctgcctcagcctgccaaagtgctgggattacaggcgtgacaaccacacccagccatgaattactttatctaattaaactattaaataaccagttaaaatccatttgaaatataaatatatgattataagaataggcagggtgcagtggctttacacctgtaatcccagcactttgggaggctgaggtgggag

SEQ ID NO: 46082 - DNA, 1149 bp, Homo sapiens
cttggaccagaagaggacccaatctgctcctagagaaacttgctacgatgcagaagtgaggttatatggaaatgaagtgtgtcctacctttcagaaacttgggagagtaggagagaccatttttgaaaatctggtgagaaatactcttacagagaaaaacacagcccaaagcacatgggaccttcaatctgaaattgaattgtactgttaagcatgtctggtgattcaaaagactggcataccttatttccagtcacttcctcgaggcctgggctttgtcaatatgtgaagatgaattttggagaatcatgtaaacacaattgaacagatctgggggatccagtctgatgggtttgctgaggccaatccagtcagccacgcagaagtgtgctggacacacaggccccaccaccccccgccaaagaggcagcctcccaacaagctgccaatgacataagcaaagcagcgtgtctcaagtgtctccaatcataagattcgcctgggaagctggttaaactaacacagcctcttaggctccttcctgaagactggattccatgggtctatgatggggctagaaatttgcatttctaacaaaactcccttgtcatcatggacgttttagagatattgatactattatttctactgatttctgctctcgggagtctgtaaactttttctgcaaatggccaactggttaacttttaaggctttgtagaaccgatagtctctctctgtctctcactactcatcaacttgatgtggtagcacaaaagcagtcagtcagcctattgctaatggtaaatgagatttagcctaaagctgcctccttaagttcggcctgaagttttctctgtacattgtgaactataacaaatgaaggtgtaacaagaccaatcaccgagtttcggtcaatcaaatgtagccaactgctcaaactgtgttcaaataaggcaaacgctgagctgtaaccaatccagctgtttctgtacctcacttccgttttctgtatgccacttccctttttctgtccataaatcttccaccacgtggccctgccagagtctctgagcctactctggcttggaagactgcccaattcacgaatcgttcatttgctcaattaaactcctttaaatttaaaaa

SEQ ID NO: 46083 - DNA, 1095 bp, Homo sapiens
cttggaccagaagaggacccaatctgctcctagagaaacttgctacgatgcagaagtgaggttatatggaaatgaagtgtgtcctacctttcagaaacttgggagagtaggagagaccatttttgaaaatctggtgagaaatactcttacagagaaaaacacagcccaaagcacatgggaccttcaatctgaaattgaattgtactgttaagcatgtctggtgattcaaaagactggcataccttatttccagtcacttcctcgaggcctgggctttgtcaatatgtgaagatgaattttggagaatcatgtaaacacaattgaacagatctgggggatccagtctgatgggtttgctgaggccaatccagtcagccacgcagaagtgtgctggacacacaggccccaccaccccccgccaaagaggcagcctcccaacaagctgccaatgacataagcaaagcagcgtgtctcaagtgtctccaatcataagattcgcctgggaagctggttaaactaacacagcctcttaggctccttcctgaagactggattccatgggtctatgatggggctagaaatttgcatttctaacaaaactcccttgtcatcatggacgttttagagatattgatactattatttctactgatttctgctctcgggagtctgtaaactttttctgcaaatggccaactggttaacttttaaggctttgtagaaccgatagtctctctctgtctctcactactcatcaacttgatgtggtagcaccctccttaagttcggcctgaagttttctctgtacattgtgaactataacaaatgaaggtgtaacaagaccaatcaccgagtttcggtcaatcaaatgtagccaactgctcaaactgtgttcaaataaggcaaacgctgagctgtaaccaatccagctgtttctgtacctcacttccgttttctgtatgccacttccctttttctgtccataaatcttccaccacgtggccctgccagagtctctgagcctactctggcttggaagactgcccaattcacgaatcgttcatttgctcaattaaactcctttaaatttaaaaa

SEQ ID NO: 46084 - DNA, 303 bp, Homo sapiens
tcagacatgaattttcctttagactaaaaatacttctgtacagatgctgcctgaaaaaaatatgataaggttggcaagaaatgacgggcaaggttaaagcgaaggatcagaagatactgtggaaaatttgtactgactcttccatcacaagtaaaaagtatcccctggatcacaaaattattgaaacatactattaaattgcctaaagctacctgaattagtccacgtacctgttcattataaaaccttaacataccttagggtagtgtacatatttttaaaaacaaagatatccaaatccat

SEQ ID NO: 46085 - DNA, 351 bp, Homo sapiens
ctgggattacaggcgcgtgccatcacgcccagctaatttttttgtgtttttagtagagatggggtttcacaatgttggtcaggctggtctcgaactcctgagctcgtgatctaccctcctcagcctcccagagtgctgggatcacaggcgtgagccaccatgcctagctaatttttattttttttaatattttgtagagacaggggtctcactctctctcccagactggagtgcatggtgttatcatagtgcacacttaaatgcagcctcaaacttcttggctcaagtgatcctcctgtctcagcctctgaagtagctaggtctacaggcatgcaccaccatgcttggcta

SEQ ID NO: 46086 - DNA, 348 bp, Homo sapiens
gctgggtgggagtgatgttgattcttagagggcctggagagatccctttaaatataccctagattgcaaactcttccaaatgtaaaatgcataaccaaccctcacccagttctctctcgcatcctccacctgtcttattttgcttttcttattttcaaaaattttatttttaattgacaaataattgcaatttgcggggtacagtgtgatattatgacgtatgtacacattgtggaaagattaaataaagctgattaacatatcagccccatcacatacttattgtgatgagaatattttaaatctccttttagcaattttgaaatatacaataaattattatgaact

SEQ ID NO: 46087 - DNA, 170 bp, Homo sapiens
aaacaagattttaagattatgtctatgtttctggcttcagaaacaggatgaataacatagggcacccctaactaaacaagagagcacaggcagacacatatttggttggagtggggaggggaaaataaccagtttgtccttcctgaatttgagatagctctctcagatct

SEQ ID NO: 46088 - DNA, 408 bp, Homo sapiens
cttgtgtcagttacctgtgagaggcacagacaagtctttctgacttctcaagagtgtcccaaacaagttagggttaaggattacccaggcttccatggagaagggtgccttacggaagaggtcttgacttctcagtgtggaagaaccttccaggtctcagctcttactgcttgaaggtccttggggtttcctactgagctctgcctctcctccttctaagaggcaagctgctcacccagggccagggccgcttctaaatgcagcctgtggacacgctttttgcttcctgttctgcttcagcagtgctttaactggggcagtgtgttactgggattgatgattgaccaaggactgcacacctcaacgttaggcaaacaccggggaagcttgtttgcagggcctggcttt

SEQ ID NO: 46089 - DNA, 243 bp, Homo sapiens
atagtgctgttaactaaactatcaaatttatttgaattttaccagttgcctctaatattctttttgttttcttccaggatgccacattacagtttgttgttatgcccccttagtctcatataatctgtcctagtctttcatggttttgtcagaatttctcagacttttcttgcctttcatgaccttgacagttttcttttttttttttttttgagatgaagtctcactctgtcacccaggttg

SEQ ID NO: 46090 - DNA, 185 bp, Homo sapiens
cattagttcggcatcaatatggtgacctcctgggagtggaggaccaccagcttgcctaagaaggggtgaaccagcccaggtcagaaacagagcaggtcaaaactcctgtgctgatcggtagtggaattatgcctgtaaatagctactgcactccagcctgggcaacatagtggaaccctgtttct

SEQ ID NO: 46091 - DNA, 4723 bp, Homo sapiens
  misc_feature (4382)..(4383): n is a, c, g, or t
gagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggatttgaaaaataattcaaaatatttgaaagcagccaaaaaagggaaagaaaaacatgagcctgatgtctcctcaaagtcgtcttcagtgttagactccagtttagaccacagacataaacagaaagtcttacatgacacaatggatctgaatcatctcttgaaagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccaggaagcaaaagtacaattcctagatcggctgatcatcccccaaagttatatcacagtgctctcaacagacagaaggaacaacaaaggattgagagagaaaacttggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatgaggtaggttttagagctagtcttctaactcgtgaatagtttaaggaccacatcagttgcaaaccaagtatttgttgaatcagtaaaatggcactatcagcatgaagagccgagaagcagatcctgaggtgtgtcggacagtgttttaggtaattcagtatttattatgttattagagaagacttagcgtaagaaagaaatgctttagaaattccagcaagtatttataaggcctgaaaaaactaaaatttgaacaaaaagggaaataaatcacacatttgttgaggctgctgctttaagtattagctaattttcttgttttggtttactttgatttatttgattgaaccctggaagtattatttttaccagtcccacatttaaagacctagtaatcttgatggaattggtaatggcagatagggtttaatgttgttgacttttcaaattagaattttttttctatgaaacttaggcttttatataacaaagtatgttatctcattgttaccgccgtttttcactactagccttttcagtatgcccttaaaatgtattggaaaggttccatgttaaatgacaaatatctttttcagtatgaatttttgatctgtagccacaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacctggccacaacctggctttgaggttctgcttttgggggccataattttcattcaatgttattcgatgctctgttctggtgaacaagttactatacctgctgtgtatataagcttgagctatactaaaccaaggctttattttcttttgttttttaacttactgtacttttactgtttatataacctatatttcaagagagagaagataatgctgaattttaaatttagcatttgaacatctgtccaatagtgaattaatcagtttttttaaaattgatttttaagttgttccagaaaaaaatatatatatatgttttatatatataatctttttatatatataaaaaatcttttttataaattttattttaaaaatcttttaaaaaagatttttatatatatataaagactatatatttatatatagtcttttctgttcataatggcattagtctctgagtacattttatattatctttgttgctacatgtcaggatacaacacaatagttttataaataacaactgtactttgattttaggtactaatttaatgctttagtttttactactttgaagggaggttcatctaagtattactgataacagggatccaacttaaagtaaaagttggaaagggcaagagtcttttaagcggaacttcaattctgttgtcatggttacttatatataatgaatataaatagacaaataggacttggaaaatgtggtatattctaagtcaagatgctatgaagttgttatagtttaagggacattcttaagaaggaattacttaagtacattactcttctcattttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggtagctcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtganngctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataaaaaa

SEQ ID NO: 46092 - DNA, 612 bp, Homo sapiens
  misc_feature (1)..(1): n is a, c, g, or t
  misc_feature (271)..(272): n is a, c, g, or t
nggctcagttaatcaggttaaacacaagggcgttcacaccccccttgtattcatctctagaaatctcgtgcgaattcggcacgagcttatacttcctctgctctctttttcagtttccataaaaagctgttttcttagctattactccaaataaagttctttggtttgcttaaaaatgtagtgtaatgcagttgttttctctccgctaacctgagtgtccacagtagatatcgagacagctttaggaaggtgacggtcatgggtaagtganngctgtgcctgtcatcttcagattcttcaaatactgcaaactatgaaacatgttaagaccaatataaacccaaagatgtgagttgattatactttaataattacattcataaaaagtttactatcttcaatgccaaaaaagtcttaacctataaatgattatatacaatcttagaaaatgtgcttaacagttatggcttctttatttctatgaggaaagattagtaagaaacttaaaattaacatccttttaagattttctgttccattttaatgtattttaggcatttagaactagcctggcataatgaagaaagaaataaaagaattaaagataaaaaa

SEQ ID NO: 46093 - DNA, 424 bp, Homo sapiens
gtgtgtgaatgtatgtatgtgtatgagtgtgaatgtaagtgtatgtgtgtgaatgtaagtgtatgtgtgtgaatgtgtgtaagtgtatgtgtgcgtgtgaatgtgtgtgcgtgtgaatgtgtgtgtaagcatgtgtgagcctgtgaatgtgtgtaagcatatgtgtgagtgtatgagaatgtgtgtaagtatgtgagtgtgtgaatgtgtaagtgtgtgtgtgtgaaggtgaaacatggtgctttccttttattgccatgcatctgttgaagcacccacattatcttggatccttaaagcacaccttgaaggtgatgctggcatgcccacctggtgccagggctggcctctctctagaaggcacggtcacactgggctgtgtgtgcaggttcccgggctcaattccagctctgtccctcattat

SEQ ID NO: 46094 - DNA, 666 bp, Homo sapiens
  misc_feature (582)..(582): n is a, c, g, or t
aatttattcaaatgtgttgacttttgatatatagctgaactttaatccaatttaaatttaatttaaacaatctgggattataggcgtgaaccaccacacctggcctattaaacacttgttctaaagagaatgatattaccatgttcagccaatgaaactgtagaataattagtacttagacgtaattgaaatgtgtacctagcagcagatctcttgcaggaagaagtctgagcagtttggcacatagataaatgggcctatgtggccctttaaggtaagagatattacccttcacagtaggtagctcttttttaaaaaatcctatcccatacaacctgttaagtggaagaaaatatttgcaaaccatttatccaacaagggactaatatctataatatacagagaactcaacaggaataaaacagataatcccattaaaaagtgggcaaagtttgtgaccagcctggccaacatagtgaaaccccatctttactaaaaatacaaaaattagccaggtgtggtggcacgtgcctgtagtcccaactacttgggaggctgaggtgggagaatcacttatacttnggaggtggaggttgcagtgagtggagaccatgccattgcactccagcctaggtgacagagtgagactccatctcaaaaaaaaaa

SEQ ID NO: 46095 - DNA, 216 bp, Homo sapiens
attttttacaaagcattgtttaaattattgttaattctgttctcattagatcagtctggaatatgtaaatgaatacagaataaatttccctcagaatgtgtcagcactgctgcacttttagtttccatgttgctgctaaggatatctgtactcatttacatattccagactgatctaatgagaacagaattaacaataatttaaacaatgctttgt

SEQ ID NO: 46096 - DNA, 479 bp, Homo sapiens
gcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcagggaggcaagttcccaagtaa

SEQ ID NO: 46097 - DNA, 2534 bp, Homo sapiens
gcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaagggatttctggaagcttgaacttaagagtgataacttagggtacctggcaaaagaaatttctgagcagcaaagcattcaagaagtggcctggctgcctcactgcttcaaacagcctacaattatatatgggagcaaaaaaatgacttaaagttggaatttatatttaaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccatcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaacgtgggcaatgtgggaaaggcttccatagtagatcagcacttaatgttcattgcaaattgcacacaggagagaaaccttataattgtgaggaatgtgggaaagccttcattcatgattcacagctccaggaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagtacacaacttcattcccatcagacatgccatactggagaaaagctatacaaatgtgagcagtgtgagaaggggtacaacagtaaatttaatcttgacatgcaccagagggtccacaggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataaatgtgagaagtgtgggaagggctttggctgggcctcaactcatctgacccatcaattctccacagcagagaaaaaccattcaaatatgagaactgtgggaagagctttgtacatagatcatatctttttttttttttttgagacagagtctcactctttcacccaagcctgactgcagtggcgctatctcagctcgctgcaagctccgcctcccaagttcacgccattctcctgcctcagcctcccgagtaactgggactacaggtgcccgccaccacacccagctaattttttgtatttttagtaaaaacggggtttcaccgtgttagccaggatggtctcgatctcctga

SEQ ID NO: 46098 - DNA, 1490 bp, Homo sapiens
ttctgactatggctgtttccttctctggggaaagcccacatccccctctatcccaaaggtgatggtgggaaggaaaggagaaatgtagccaaaatggtttgcagttctcagaccaaagccggttttcgtcagtatgcacaaaagcacgtgagcctttctttctcttccctgttgtgccctgagactgaccttgacaatgttcatccctcagctgcctgccttaggactgacttccttgatgatggccatttccttgaatgtgtctgtttctcagggtctgtcctctgcatgcatgcatttgcgcatgcaggcatgcaaacccacaagagtccaggctaaagttttgggggattgggtacaggaaaatcatgtcattgagaatggggcaaccctgaggccatggcaggatcccctgcatgacaaatatagaatgaagtaaaaataatcagaggaagccgggccattgatgatgctatcagtcttagtggggtgatacaccagacattctgtctcatttctcttcaaacgaccgcatgagtggtcatggaaactacaagtcacacctctccgtatttggaaaagcagatcgtttctctgacataggagtaataagctttcttgacattttgatagcagtgagggaagggaaaaaaggcagggaggagttggaggtggggtgaggggtagaagccgtcatgtgtcctagagctctctgtaccagcgttctggtcaactgtacagtattttcttcccactcctcaggcatagcttgggaaccaggaacagcagaacccaagtggtctggcaaagtgtttgaatggtgctctgtcacctagtgccaaaagcagattgctacactgaagggagaaaggctcttaaaagagaccattgtgtttaatctcactgggatggtcagttcctcttggccttcctgtttgctccgtagttgcgaacactagtttcaggggggtcaggctcccgatctgcgtcattatcctgtttaaatagggaggggcaggccctttcctgctgtctgtctcccatagtctctggctatgaggcttgagtgacttggacatgacatttctctttctggttcattcattttccccacttccatctgaaaattctaaccaaatgtcttgctgaattctctaagtacaacaatttcaccctccctgcagacaatgaggaaatcagagtccagaatccatttcaacttagcaaacatttactgagtctatattttgtttcggatactggggtaaagttctggaaatgcaaaaggaatttgcatctctgaacttaaggagttcacagtcttgaacagggcaatccaagttgtactgtaaagaaatagtatgatcgagaactgggaaaggaaacagcctttgaatagatacccattctggttaaatggaagatgggtttcgagggaggaaggaatttaatgcaggaaagccaattgggaagcaatttctgtgctacag

SEQ ID NO: 46099 - DNA, 389 bp, Homo sapiens
aaaaaaagaggacgtagactagctacgatagcccagatactattaggtactttatgtaaacaaatcaccttttatcctcacaataaccctagagagtaggtgttattatctatatgtgacagacaggataacttaagcttacagagaggtcacgtcccagattgcatagcttgtaagtgattggtacctgttaactaactccgaggctgctggctcttccattacaacacagcctttataccaccctaaatatgttgtgttgaggttgctgtctcctttaagaaggcttagggtgactggtgttaaaactgtatgtagacagtagccaaggcactgggatccacactggacagtgacgtagggaaaggttggagtaatattggtaacgt

SEQ ID NO: 46100 - DNA, 391 bp, Homo sapiens
cccatcaccattgtagtattctgttgattttaagcaactcacagtttctgactacattcattagaaggaattaaaatatgaagttacttatcaacttcacttatacttagaggtgggagtcgttgggtgccatcttaggttctacctaccacatctgatcttctccaatatgagatagtttttcagtcttcacttattttctattaccttgacccttttgacaaggactggtcagttctattgtaaaatttcccacagtatgaatttgtcagatgtcttctcataattagactagggatatggattaaattcaatattttcaatatttatatttatttaaatttaaagatgagacaaaacaatataatatttatatatacaaacatacagg

SEQ ID NO: 46101 - DNA, 340 bp, Homo sapiens
taatcccagtactttgagaccaaggtgggtggattgcttgagcccaagagttcaaggctggtctgggcaacgtagtgagaccctgtctctgaaaaaaattaaaaattaaaattaaccaggtgtagtggctactgaagaggctgaagtagaaggatcacttgatcctgggaggtcaaggctacattgagctgtgattgtaccactgtactccagcctgggcaacagagcaagattgcctcaaaaagaaaaagatcatttacaaaaccctttccaataagaccatttcagtacttataggttgtgatgcattcttctttgtattaatctaagattttccaca

SEQ ID NO: 46102 - DNA, 607 bp, Homo sapiens
taacactcccctccaactcaggaagaaatgtgtgcagagtccttagctggggcgtgtgcactcggggccaggtgctcagtaggcttcggtgaatatttgttggctgatttattcagaaattctgtccagcccctaccttggatggatttatcacctctccaggccacctcttctttccaaatagggccacctaggtatagaccaaagacacgaaatcttttgtgatcccacaaacacagagcaggtcaaataggcccaagccaattgagactgtggttcacgtcgtgatgcagagtttgctgtggacgtgctcccactgcgtactagctgggcatgtggcttaaccttttctcagcctcagtcgccccattgtaaatggagataatgatactatctcccctcacaggactgttgggatgctactggatttaataagctaatgcagggacatgctaagcacaacccatccctgaggcccagagaggggtgggccttggctgaggtctcactgcgaggtgggaatgtgggcctccagaccagaggtaggtcctgtggcccctagacagtggacagcaatggtcagtttgacacaccagagccctagcca

SEQ ID NO: 46103 - DNA, 658 bp, Homo sapiens
tcacaatcatgaacatgattcagtgatatgatttggatgtttgttccctcaaatctaatgctgaaatgtgatccccaatgttggggcctagtggaaggtattagatcatgggggtggatccctcatgaatagctcagtgatgagtgagttctcactcagttaattcacacaagatctggttgtttaagagagcctgagacctctcccttgtctctctcgccatgtgacacctgggcttccctttgcggtctgtcatgatcgtaagctccctgaggccttgccagaagctgagcagatgctggtgccatgcttcccatacacagtgcagaaccattagctgattaacttcttttctttataaattacccagccttgggtatttctttatagcagtgcaaacatggcttaacactgtcagttaggaaaaaaggtgttaaaatagttccaattgactgctttgatttttttccctcttaattttgctactatttgttcaagtttctgtagtgctagcagtagactaagtaggtaagaaaaaattatggtagagaaacttatgaaaaatccatctattaattttctttcctgtgaattagaaaaataccattgttcttttccagccaaaagaatatctccctctaggagccattaaatattt

SEQ ID NO: 46104 - DNA, 379 bp, Homo sapiens
gcccaccctctttaaagcaatttatttttagactaccacacatagcttcacaaatttcatcaattgacacctatattcaaaatccctggcctaccagatctttgccatacctttatcctcaataagttctacgtaagttttgctcctaacttggccatttccctggaacatttttcactgtgccttggcatatacagttccgttatcagctaactccacaaacatcctcagtctttctgagattgttccttatacttgtcttaattgaatctaaaatcacagttcccctaaaatttggtcaagtcataaacttgtgcctcaagatcaggagataagatttgtattctttattttattttgccagataaatcaccacaac

SEQ ID NO: 46105 - DNA, 419 bp, Homo sapiens
ttcattccatgaatgctagcactcaaaatcaaacaatgtttctctactgttgaatccaaatgagataattataccacccactgaggcaccttattttcccactgcccccgactccaaaaataggaaacctttagaaacatttatacaaagtccaagtagcattcaatacatagtggttaaatttgtgatctcagaatgacagtggctgagttagaagctatttatttaaaagctgtattttcttgggtgagttttaaatcactgtctatataaatttctttatgtgaaaatgaagttaagaattggattatctcataaggttgctgagctgatatgtaaagatatgtaaagtgcttagagcagcacctgacaagtactaagtgctcaataaatgctacctgtgataatttagacatgga

SEQ ID NO: 46106 - DNA, 434 bp, Homo sapiens
tattgatctttattgttcatatggttgtcagacttgtttaaagagggtctttgtctaacatgtttgagctagatgattacttatgttaagagtataagatgacaattcttggaccatgagactagtccccatatctaatgtaatctgtagcctttaaaaaaattaccttggttattataacaatactttttattcttttaattatgaaacactgtaatttggaggttttgtagggagaggctggtaagaaaaccggcttgcctttctctctccctccctccagtctttcctttcatctatccatctttctaaagctcattgctctttgaaaagcctaacatttctgtagttttatagatataaatatagttgtctcatccctagagcaagtataaccaaactaagttaaactcatataatatgggacctcattg

SEQ ID NO: 46107 - DNA, 474 bp, Homo sapiens
cgaacttggggcagcccctggaagtcttgttctttgaccattacgtctgcggctgcatcaccagataatgagcttcaccactcgtctgcctcctgtgtccttccgcggggagtaaatgtcacttcagcttgccgcatctctaaataggcaaattttcagtgctcagaaaaggacctgatctttgacaaagtgctttgatggttgcctgcttgagtcactcccaatcccttcctgaagccctttctttataattcttctgttgaaatagccatcatattcacagtactaatcacagcatctcacatttactaaaaacttaccccataccaggaacccagagttgggggggctgtgtcagaattatgtaatttacgtgtcccaataatcctagacgcttcttgaccatctagttttgtcaaatgagaaaactgaggttccaaagaagtcaataaacttgtccaaagtctgaccgac

SEQ ID NO: 46108 - DNA, 553 bp, Homo sapiens
taaatagagaaaggtctcaccatgttgcccagctggtcttgtactcctgggctcaggcaatcctcccgccttggcctcccaaagtgctgggagtacagcttgagccatcatgcccagacaaccaactacttttctttcccctaagaaaaccacatcctatattaagtccagcccttactgctctagcattttggacaggcaaaaactaacctgaggtgtgctctcttcagcagcacatatactaaaattggaatgatacagagaagattagcatggcccctgtgcaaggatgacacgcaaattcgtgaagtgttccatattggaaaacaacaacaacaacaacaacaacaaactaacctgagatgaggaaacaggcatggtatacgcattcattaaactagccaggctcgcaaaaagagaaaccacaccacagctggaagtaatgggggagaatttaccctgctcccaactgtaacaattaatcatctgcagcagctgggaattttttgttgttgttttgagactgagtcactctgtcacccaggctggaagg

SEQ ID NO: 46109 - DNA, 418 bp, Homo sapiens
caggaaacttataactcatggcagaaggtgaaggggaagcaaggcacgtcttaagtggtgtcagaggagagagagagagagcaagagaaactgccacatttaaaccatcagatctcgtgaaaactctgtcactatcatgagaacagactgtgggaaactgccatgatccagtcacctcccactaggtccctcccccaacatgtggggattacagttcaagatgaaatttgggtgaggacacaaagccaaaccatattcgattgtgaattctttttgaggtatagtgcttaagaatgcaggctcttggccgggtgccatggctcatgcctgtaatctcagcactttgggaggctgaggtaggaggattgcttgagccaggagttcaagaccagactgggcaacataatgaaatccagtc

SEQ ID NO: 46110 - DNA, 499 bp, Homo sapiens
attaaatttttttagactcaaagctctccacaattggaaagtagctcatactactcactatggcctacgagcccctctggtctggagcctgaccccaggtcagccctcatctcccacccaccactcagccttcagcccctttgccactgccacgtgggcctttctggtgctctccagatgcccccacctcgttctgctacaggactttgcacttgatgggaagcctggcttggtgctctccttcaagacctttgtaagcttccattcaaatgccaagttttcagaagggcttccctgccacaccccatctcagaagagctcctgagtctcttgaccccttgtgctgcttgctttcttttcacagttcttattaatttctaataagatttatacgtgcatgtttgcgtgcatgtgttacaaatatatacactcttatatacatatacacatacatatatatacatacagacatgtatacatatacacatatatacctata

SEQ ID NO: 46111 - DNA, 356 bp, Homo sapiens
aaagtgtaaatcagtttgctggaccaaaaaagcactattgaagctaaggatctaaggatctggcaagatttttttgtataatttttattaaatctatttgcaaagttttattagtatgctgtgagaattctggttggtcagaatttacaggtaatgattttcctaggttctctggtttacctaggaattatccccaaaacctatgtttcactgttacttgaaaatcttttaaaatgtatatgatactgccctatcttataaaatgtgatataaatatactttactttttctctgactcatggtcttagcacttacttggttaatgaaccagtcaaataaagcatgtgtatgaggtc

SEQ ID NO: 46112 - DNA, 422 bp, Homo sapiens
tcagggcctcacagagcaccacgtggtgtcattgctggtcctgccatagctcccaggaccaatgcttcccagaactccctgctacataaatacatccggtccctttccctcgagatcttgaaaagtgaagacttcacttggcagtaacggtaaaacatttcaacatggtaagttgtcattttatgcacacatggaatggtggcccataaagggcctgggggtccaatatcctacatactggactcctcattagtcctctgagtcttctgttccccaacacactgcattgggatcaaactgaatttgcagccaggcatcatagctcatgcctgtaattccagcactttgggaggctgagatagaggatcacttgaggccaggagtccaagaccagcctggggaacataacgagaccttgcctc

SEQ ID NO: 46113 - DNA, 2409 bp, Homo sapiens
gttcattcacggagttgtgcaaccatcaccaccatcaattttagaacattttcatcacctcaaagaggaatcccttgtccttttgtagttatggccatccctggaagagtactttttttttttttcaactgaagcacccagagctcttgggttccctcttaactgctttctgtggaagtatagagggccatgtgagggaagccgttatccagagtacatgactgctagaaaatggagtttggggctccctcttcacttctgctgatagaagcataatggctaggggatgggtagtctcaccagagaatgtggagctttcagactctccttatatatgataaaaaggatttttcattgtagtggggaaaaggtggtttgatcaaatggcattgggaaacttagctcactggaaaaacagatctgtacctttcacactaatgaaatgcctgagatattaaaggtctaaatgtaaaattaaagtacatgaaaaacagaataatatatatgtaccctcggtttgaaatagactttaagcactaatgcataaccccaaagctgacattaggcttttatatggtggaaaacatcatagtcaatagataaatgagagactgacacaaagtgtttgcaacagatataataaaggactgtaattccgtgatattcaaagtactattacaaaccaataataatctgcaacttagaaaaatggactaatgtcccattcacaaaagatgcaataaaagcagttaatgaaaatttatccaatatcactagaaatcaagaaatgcaaattaaagtgattatctactttttccccaaaagactgactaatcgagtgataacattcagtattggtgaatgtgtggaaacaagggaattccattgttgattacatatctattgctttatgtatataccctttgaattaatattccttggaaaccaacatatacaaaggtagataaatgtattagtggcaaaaaaattaatggtaaactattaaaacaacaagtgtccatcagggtaataaataaattaattatggtatatatccattcaataggaattatgcagctgttgaaaaaaaatcaatgtgtgtagtcatagaaagatagctgtgctatactaaatgaaaaattgcagacctgtattgtagtataggcccataattgtgatatcaaaaataaaaatcaaaatatatattatagtaggcatttgtttttctctgcccagtttcccttgcctcctccttttggctgcactatctcatcttttccttttgagtaactggccataccctaccatatgtttttgatggacgtggccaataaaattgtctctgaatttcaaaaggcatttggatctgtgtcatccaatggcaactccctaaaagctgatgcagttattcttttgattggtccttggaaccaccctggtttttgtactttccaagtctgtgattcctcaaactacccattgtctttccggtacttgatttttgcctcctgttggtcagttgcttgcaagtaaagaaacaatcatacagaatttggtacgaagattgggtaatgggcattagaatctttggaaaaatcaggtattgggagttgctttttggatgagatggggcgaataagacttatattctagactggaaagcatctcatggtgtgcgatgagcaaacgcctgattattcattatagtcacctgggatgaatagaggtctagggttctggataatgataatttaaggaggatggagaatgctgaatccaaaaggtatatgtaatactggtatctaactgcttggaataacttaaagtttagctcttgaatttctagcattaaggcaaaaaaaattcacctaagggattttgtatgatattgttgaaagatgtcttacattgtttaaagtcatagggttaagatggctcataaccaaatttagagactatttttatgcattgttaaagtggaatgctggttaaattttatactttattcacaagagtcactgtgaattgaattgtgaattcagttctgaattgtgttcccaccagcaccaccaaatgctggcctctaccaccaccaaatttacttgttgaagtcctaaaccccaacatgactgtatttggacataaggcctttaagaaactaaggttaagttaggccataagagtgaggccctaatcccataggactagtgtccttataagaggaagagacaccagaggtttgtctctccacatgtgcacagaggaaatgctgtgtaaggacacaacaagaatgctgccatctgcaagccaggaggagagacctcaccaggaaccagccctgccagcaccttgatcttggacttttaatctccaggactgtgagaaaataaatgttggttgtttaagcca

SEQ ID NO: 46114 - DNA, 432 bp, Homo sapiens
tttctaaaccagatgtgatctccttactggagcaagagaaagacccttgggtgataaaaggagggatgaacagaggcctgtgcccagcaccaccaaatgctggcctctaccaccaccaaatttacttgttgaagtcctaaaccccaacatgactgtatttggacataaggcctttaagaaactaaggttaagttaggccataagagtgaggccctaatcccataggactagtgtccttataagaggaagagacaccagaggtttgtctctccacatgtgcacagaggaaatgctgtgtaaggacacaacaagaatgctgccatctgcaagccaggaggagagacctcaccaggaaccagccctgccagcaccttgatcttggacttttaatctccaggactgtgagaaaataaatgttggttgtttaagcca

SEQ ID NO: 46115 - DNA, 602 bp, Homo sapiens
tgatgcagtaagttaagaaagagaaataaaaaacacctagattggaaagaattaaaactcttgtaaatgacatgatcatctatgtagagatcagatggaatctacagaaagctattagaagtaaggtgaatttagaaaaattgtagtatggaatatcaacatacaaaaatgaattgtatatgcatttcataataataaacccttggaaattgcaaataagaaacaatttgtaatagcatctcaaaacatatgatagtactttgggataagactgacaaatatgttgctatggactgaattgtgactcccaaaatttatatgttgaagtcctaacccccaatgtgatggtgtttggaaatggggcttttgggaagtaattaggtgtagatgagattatgaagatggaaccctcatgatacgattagtgcccttttaaggagatgccagaggctttctgattctctctgccgtgtgaggacacagtgagaagtcagccgttggcaaactaggaagaaagccctcaccagggaactgaatcagctggcacattgatcttggatttcccagcctgcagaactgtgaagaataaatgattcttattt

SEQ ID NO: 46116 - DNA, 1089 bp, Homo sapiens
tgttttggcattgcaaggttcaagtgtaataaaacttaaatgtagtgaataaataccatgatttggagtgttgctgtggctatgaaagttagtttcctttcttcatctttttttttttattaagtaatcagtgacttgaaaaatagcagattggtataaggattgtaacttaagaaactgaaaactcccatgctttaaaggagtataggctttgatatttttctgcggaacattttcttcactcatttaaatcttcctaggctgagattaagcattcatcctgaaatgtacacttgaatagtttgaaattcaacacaagtgtatatttttagtgaagacattttctcttgggttatcagtggtcagtgatgtagtggtggttttgcttgaccccagggtatttacagaagcctaggatctgagcaaatatctagcccaaccccaagttgggactaggtctcacttattggtacagcacacctaatgttttatgcctttcacccaaaaagcgtttttacggccaggatgtgcccgtagtcaccaacagtaactgctgggagacacgtcagggagaggtagctgtggtcactgccttgtacaacagccaaaagcccaaagcaggagggaccctggccttctcccagcacacaacgagtgggagctctgtgtgctggccggcatttcctgtcacgttcaataggacacgttcactcttcatacttcttcaattctaaatttcagaagtaatttgtcactttagaggagggcgtcattaataaccattatttagaactgtcgagtcttcctctctgtgagtgtctgagttaagcatccccaaaattggccttgttggtggcaagcagtgcccccacactgacagattgagactaccccacccccaccgacgccctcacaacccagttcttccccgtctgcctttaatcaccgcgaggggggcgacagggaatggctacggcatgtcctcctggaattcattagcgttattaccaaagaccgtgttgtaaattgagattttttttaactgctaggaaaaaatttctccttaactatttcattttattgtactta

SEQ ID NO: 46117 - DNA, 349 bp, Homo sapiens
aagatgatagaataattatttttcacagtgtccttcagtttgggtttgtgtgatgcttcctcaagattagatttcggttgtgcattttcggcagggctatctcacagattatagagtgtcaggaggcacgcactgccattttatcctattattggtaatactaactttgatctcttggttaaggcagtgactgtcagggtttacactgttgttacagtaggtagctagtcagacatgagcagggcagaagggggcctcccccccaggaatgtcaggcaaccattaggcggtggtcaggctgttattaaccatctctctgaaataataattggtcgcagccggtgccagg

SEQ ID NO: 46118 - DNA, 480 bp, Homo sapiens
gagtagctgtagccttttatattccgagcagcaatgtatgagtgatatagtttctttatgtccttgtcagcatttggtcattgttttgttttgttttttagctactctagctgggacatgtttttatttattttttattttttacttttttgagatggagtttcactcttgttgcccaggctggagcgcaatggcatgatattggttcactgcacacctcccaggttcaagcgattctcctgcctcagcctcctgagtagctgggattacaggtgtccaccaccacgcctggctaatttttgtatttttagtagagacggggtttcgccatgttggccaggctggtctcaaactcctgacctcaggtgatctgcccaccttgacctcccaaagtgctgagattacaggcatgagctgccactcccagctgggacatgtttttaaatccactttgccaatctcatcctctcctgtccctca

SEQ ID NO: 46119 - DNA, 297 bp, Homo sapiens
cagctcaattagattaattaccttcctcaccaggagtcacaatgctttgcagtttatctgcggtaactaaatgttagttttgtaagtaaaaggtactgttattgacctcgaaagggctatagttcctttgaacttacagagaagagttccaaacaactatttctaaccaagatgtaatatgggtcagcaaaattgtcttcaggtagagttttctacttgccaagagactttggcattgagaggagagttcttgtttgttttttttaactctgtatcatttctgtttggtgtctctaa

SEQ ID NO: 46120 - DNA, 394 bp, Homo sapiens
atgaggcttcctctttcctgcctaactgtcccaaggcctctcctcctccaatgaccatgtggcaatcatagagggggtcttagatagtattcctgtatcaaaggaagtatgtctaaggaattggaggatgctggtcgttagcctctgattgataagcacttcttatttatttaatttttttttaaaatagagatgggggtttcaccctcttggtcaggttggtcttgaactcctggcctcaagttatctccctgcctcagcctcccaaagggctgggattacaggcatgagccaccacgcccagcctttgattgataaactcttctttcctcttccttcattctgtaatgcaacccctaaaagtggcaaaatcttgttttaaaattttgtctgt

SEQ ID NO: 46121 - DNA, 407 bp, Homo sapiens
ggagagtatttatcatgggagttttgtgctcatataactttaggaaatgcagggttgaaaaagttaaacattttaaattctagatttctcagaagttttaatacgttaccttctgaatctttaagacagagctgtagtatacagtgactctgaccatggaactcttttccccgtggcctgtacttccatgaatagacatctaagcagataaataaatctctaacagcatctaaaaattataatggaatattttaaagatgctcaataatcttaatgtaaaaacattatttatatagatataattttatcacttatagttactagatctgtattttgtatttatatgttgaacttttggaaattaatttatacataatgaaagaacaaactctccattcttccattct

SEQ ID NO: 46122 - DNA, 409 bp, Homo sapiens
aggatagtgaagggaggagcaggagcaggcagctcggcggcattccccaggcaccgcattaagggcctgattaacttaaaatatttcccagcttctgaggcacttgattaaagtcaattggggggaaagaagataagctcttacaagggctaatttgaggcttagaaaacttgaatatgtctaaatctcaaattgtcgggtgtgtagcgctggtgattgtcgggtctgtggggagagcgttttaacatgctggcggtgcatccgcggtaccacctgtcccagctccctggtccccacccttcctccaggcaactgccttgcgtcccctcccatcttcccttttcttccgcttgtgagggcttagacgattttgccttttgaaggcacggaaatagatggctttacattc

SEQ ID NO: 46123 - DNA, 810 bp, Homo sapiens
ggcacgagggattgaaagcactctgcagataagttactctgtatttcttttttttttttcactttattttttatttttatagacacagggtctcattgtgttgcccgggctggtctcgaactcccaggctcaagtgatcctcccacctcagcctcccaaagtgctgggataacaagtgtaagtcaccacacccagcctctgatttcttttctaaggggatgacctatttctgtttataatccaaaatttatcagccttggccctactgatattttgtactgcgtaattggagggaatgtcctgtgcagtgtagggtgtttggcagtatctctggcctccccactacatgccaatagcaccctcccagaccaaatgtcctctgggggacaaaattgccccttgttaagaaccactgttttaatctatgtgtaacacaaatttcaaaacactttggtgagtacatagcatggattatgattttttaaaaactttgtttctttttaagctgattctattctagtcatggtcatattttttaaatctgtagcttttttcctactgaagagacttttaaaaaacaagaatatgaaagtcttctgtgtccaccatcaggccaaactataatgctttaagagaaaaaaatgcatagaaagataattattttaccttaaaaagcataaatgttacttaagaagttaggattgggtggtttggaggatgagaaaggaaaaagctacatttaagtaacaaaggtttgttaagagctttctgtaacactctgtttagtggacatttgaactaaaggactcc

SEQ ID NO: 46124 - DNA, 456 bp, Homo sapiens
ataaaaccgagtgcaaaaaagatgtaaacgctcacgtatttattgtagctttacttacaaaaatcaataggttaaagcaatccatacttccctcaacaaacaaatgaatgggtacaatttggaatataaaaacaatagaatattacccagcttttgaaaagcagaaaaccttttatctataataaaaataaaatcttgatgacattatgctaaataaaataagccagctacaagacagatactgagtgtatccacatgtataaaatatctaaagtagtaacatccttagaaacagagaataagatagcatttgtaaagggctgaacaaaggagaagacaggcagttgtttcaggtgtattgagttttagttttgtaagataaaaatgttctagagatacgtcgaataatgtcaatgtgctgaaaagtctaaactatataattattgtcattgtaaa

SEQ ID NO: 46125 - DNA, 534 bp, Homo sapiens
atattttggtattttgggttaaatgaaatacattatgtgtgttgccttttcctcttttttcctttcctttttttaagatagggtcttgctctgtccaccaggctggagtgccgtggcatgatcatggcagcctcaacctcctgggctccagtgaccctcccacctcagcctcccaagtagctgggactacagcgcctgccaccacacccggctaattttttgtatttttagtagagatgggttttaccatggtctcgatctcctgacctcctgatctgcccaccctggcctcccaaagtgctgggattacaggcgtgagccactgcgaccggcccactttttctttttacttttaaaaatgtggctaatagaaatttatgagattatatttatggttcatactacgtttcttttggacagtgccagagtgaatcagataagcttgcattttaaaatcctaagggtaaatgcaatagagatagaacgcaaataattggggaggggggttgactgaaattaaagatgtataatcca

SEQ ID NO: 46126 - DNA, 510 bp, Homo sapiens
actgaacagctgttacaagagtccataattgcagaactattgcaccactttcatcttggcaccaggatgggtgaatgagtgagtaaaaaagcccctcagttcacaagacgacagactattttcttttctacctatgttaattttccatttccctccctagcaacaccagccccacaccatcttctgtgaaacatgtcaaaatggccttaagcctggaagaagtctcactctttcccaactatctaagagtctaggctgacataaaatgaataattatctttggctttgtaagcagcaaagccaagcaagtcacttcaggagtccaaatagtggacctgcctcaatggcatcttgccacagtatttctccgtagcacacaaacactctcccagggagaaataccaccaattatagaaggaaagaggaaaataaatacctgaaaaaatgtaaatcagataatgtgatagcctcacagatttaagcatctttaaataacaataaatttatatg

SEQ ID NO: 46127 - DNA, 506 bp, Homo sapiens
agctggtaagaaatacgtataaatttttttggggtaaatataaagagttggatgaatgggaacatttctagaaatatatgatgccaaaatttgctgaagtgaagtagagaacttgaatagttctataactataaaggaaatttaattcagtaatcaaaaatcgtcctataaagcaaaagcaaaatcttgaccaagatgactttgcaggcaaattcaaggaagaaataagtctaatcttttttttgagaccgcgtctcactccagcctggacgacaaagtgagactctgtctcaaaaaaaagaaaaagagtttcccacattagaaatgaacaaaaataggatactaaaataagcatttattctgtccagtattctggaaaagaataccaggctgggcatggtggctcatgccagtaattccaggatttggggagaccgaggcaggaagatgccttgagctcaggagttttgagaccagcctaggtgacataggaagaccttgtctca

SEQ ID NO: 46128 - DNA, 357 bp, Homo sapiens
aactcagacccagtgaaggggagagccctgcctgagccctcccagccagtggatggcactgccaggctcagtgtggactcacagtccagtgctctttccacagctcagtgccttctgtcaatacactttgcccaggttgtaggacttttccctcagcctggtgttcagtcccgtcagccctttccccagggcatccactaagcccttcttcaggtctttgtgaagtcccagccaccttttggcttagtgctactgtcttcttgtacccagtgtccctcccgggtatggacacttgacctcagctaatcagggccagtaacccatctcccatcctcctggcgtcctggaagcctggaa

SEQ ID NO: 46129 - DNA, 726 bp, Homo sapiens
tcccacctatgagtgagaacatgcgatgtttggtaaactgtgctataacttctgtatctctataggccaatccaaatggcctgagaacataatcagtatcccctaatctgcaaaaaggtaaataccttagtcttcagtacctttccttccagtattatctgcattatctgtgcccgcttgctgtgatgtcttgaaaagcccataaattggttcttattttggcaaatggtctcctgcttttcctcactgaggcttataaactaaatttgcctttggctaagcgcagttacatgaaccaaaaagaacattttagacttgggaagcaacaggctgagtcacattgtatggggcagagttggccaagcccccggcagtcacagccctactctctgtgttccttctaggcctgaggacgcatcaacacaaagctccaggcagttgctcctggttcatcagagagcacaggaaatttaaatctatttgcctttcctgtcataaaagaaacagcacactgactttcaaactcaattgcattttgcttatttgtgcttaacaaaaaatatgtgtgctttgccaatactaacgtcccacttctctgcactccctttctgtataacagggattgcttttgtatttgtttcttatagatgctgatgatgtgccttattcagattagttggccattaccagaataaagaataaatttgaatttttttcaaaaaaaaa

SEQ ID NO: 46130 - DNA, 456 bp, Homo sapiens
tatggaattgcaaaggaccctgaatagctaaaatactgaagaacaacaacaaatgtggaagactcacaattctcagtttcaaaatttactacaaaactagagtaatcaaaatagtgtgggactggcataaggataatcatatagaccaaaggaatgtacctgagagtccataaataaaaccatacatctatggccaacttatttttgatgagagtgccaagatattcaatgagaaaacagtctcttcaacaaatggtgctgagataactggatttccacatacaaaaaaataagccgggagccctacctcatatttactatatatgaaaatcaactctaaattgataaaagacctaaatataagctaaaaccataaaactttgaagaaaacatagggtaaatctttatgaccttagatttgacagtgggtagcccttaagctgcggggatcctcac

SEQ ID NO: 46131 - DNA, 523 bp, Homo sapiens
tatggaattgcaaaggaccctgaatagctaaaatactgaagaacaacaacaaatgtggaagactcacaattctcagtttcaaaatttactacaaaactagagtaatcaaaatagtgtgggactggcataaggataatcatatagaccaaaggaatgtacctgagagtccataaataaaaccatacatctatggccaacttatttttgatgagagtgccaagatattcaatgagaaaacagtctcttcaacaaatggtgctgagataactggatttccacatacaaaaaaataagccgggagccctacctcatatttactatatatgaaaatcaactctaaattgataaaagacctaaatataagctaaaaccataaaactttgaagaaaacatagggtaaatctttatgaccttagatttgacagtgtattcttagatatgacataaggtaaaaactggacttaatcaaaatttttaaatttttcatttctgcaaaaaaagttcttggaattttgataggaat

SEQ ID NO: 46132 - DNA, 246 bp, Homo sapiens
atgtttgttggattttttttctttactgccattatgttatcacagtaaaggatagtttaccttaaaatgtttgcaactcaccctcaagcaatattgacattcttattttcagatcatttcacttcagtgagcacaatgttttaatttttaaaaacgtttttgcattcttttgatttttctcttacgtggtttaaaaagtgggctttattatatatgcttcctcaattgtagttcaatactttaata

SEQ ID NO: 46133 - DNA, 447 bp, Homo sapiens
ggagatgttcaagagaggaaattgaaagcccttagatgtggctgttgaggagaaggagccccacatggctcccaggctttctgcttggcgacagtgtggatgatggtgtttttgacaaaagataaatgataccagagtgggagcaggttgggggaaggatgacaagttcagtttcaaatgtgctgagcctaaggtacatgtgggatatctggtggggggcacgtgtaggaggctgcatatggatctcgtgtttggagatgaggccctgtctagagatggaggttggggtgtcatagtcacatggatgatcattgaaagttgaggccacagctgcacatggtgctcacccctctaaccccagcattttggtaggctgaggtgggaggatcacttgagccctagagtttgagaccagcctggtcaacatagtgagacctttttcctaaa

SEQ ID NO: 46134 - DNA, 422 bp, Homo sapiens
tcctaatagcacgtattaccatcaaatattccccaccagtacttgtttgtttgtgtttggtttatctcctcctactagaatagggcctttgtttggttcacagtggcccatcctatgagctcagtaaatattcgaacatatttcctttaacacaaaaaataaaaggattctagaatctgtaagcctccagcccccagtaattctgtcagcagttaatagtgttgccactttaagtaaatatgattattatttattttttccatgtaaagaatagtttacagtttttactactcttacttgatttaccttttccacactgaatttgtttagattttttggaaacagatttctcgtccattaagatgctttgaactaagtgttcttgaacatttaaccaaaactgtaggtgttctctatttaaa

SEQ ID NO: 46135 - DNA, 2544 bp, Homo sapiens
  misc_feature (1127)..(1127): n is a, c, g, or t
  misc_feature (2537)..(2537): n is a, c, g, or t
  misc_feature (2543)..(2543): n is a, c, g, or t
cataaaagtgagaaagatcaagctggacttgagccactggccctcaggctcagcagggagctgcaggagaaggagaaagtgattgaagtcctgcaggccaagctggatgctcggtccctcacaccctccagcagccgtgccttgtctgactcccaccgctctcccagcagcacctctttcctgtctgatgagctggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaagcccattcaggtaccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggagtccatctgcatcaatgactgcctacgggagcaactggaacaccggctgacctctactgctcgtggaaggggatccacttctaacttctacagtcagggcctggagtccatacctcagctctgcaatgagaacagagtcctcagggaagaaaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccaggtaagaggngacccattgacagagaaggtagcattcttcattcttacattcattcttacattacaagaggaagggatattggcaagacaattgatgtcctcttttggaaacctaaatgttccctctgctattcctgatttttgtgtgtcagtggggtggggggaggggcgctttgagcagaagaaaggacttctctgggaatgccttgtcactcccaagttgagagagtaaaactctgttatagaagtcttcagtatatcagagacatgaaaaaagaagggttcccatgcttccaattagatataggacattagtctcaccatcacctaggaagcttctatactggctgtgatgcttggtcccagcataagccctgtaactgcttgtcagaatgcaaacagcactgtaggaacagtaaggagactgtgctggtgtgtctgttctgctctgaactaatgtaggtaatggtgtgttttcaagcaaagttacttgacctccctcagcctccatttccatatctgcaaaataaaagtgatagtcttcatgaccccctgagttgacatctggggctcagatgtaaccctaactgtaaccctttatgaccctctgagttgacatctggctctcagcttgttgctctggtgtggctgagtagctctgccatctcagtgggccttgcctctccctggtcagactgcagcacaagctggttctcctgcagcaacagtgtgaagagaaacagcagctctttgagtccctccagtcagagctacaaatctacgaggcactttatggcaattccaagaaggggctgaaaggtatgtgttcttctcccctcaccccatgagctttttgcccttgcataggatgctagtgaggtctttcctttgggagttgtggagatcatgggaagctacagagttctgtcgcagaaacccccacccgagcctggggctcccagtaggagctctcaaacacaaagcccaacgggacaggttggtggcacgagcaagatccggcctgatcattcctaattactttaagaaaatctagacattcctatcaatgtctagattgtaacatttttgaaagcaaaagaactgtcctaatgatatcatcatttgaaaaggcctttaatattgttggtaatacatactgacaacccattcagcccaatgtagcaggcagtctgctcccaccctgaccctttccgtagtgacatctggctctcagcttattgccctttcatgtaattttcataaatcctgatttagtttcctgattttctaaagagaaggtgaactggaatttgaagaaatacaggggcttaccaggctgggcgaatagcttaagtacaaagtcatggtgagtgttgagtcagtggggaccagcctgcccacaggagaaaattaaaagacncaaaanc

SEQ ID NO: 46136 - DNA, 1101 bp, Homo sapiens
  misc_feature (1094)..(1094): n is a, c, g, or t
  misc_feature (1100)..(1100): n is a, c, g, or t
taacgaatgggaaacttttgaaagtttctgttacccaaatgtctactttctgggacaggatccacttctaacttctacagtcagggcctggagtccatacctcagctctgcaatgagaacagagtcctcagggaagaaaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaaggtatgtgttcttctcccctcaccccatgagctttttgcccttgcataggatgctagtgaggtctttcctttgggagttgtggagatcatgggaagctacagagttctgtcgcagaaacccccacccgagcctggggctcccagtaggagctctcaaacacaaagcccaacgggacaggttggtggcacgagcaagatccggcctgatcattcctaattactttaagaaaatctagacattcctatcaatgtctagattgtaacatttttgaaagcaaaagaactgtcctaatgatatcatcatttgaaaaggcctttaatattgttggtaatacatactgacaacccattcagcccaatgtagcaggcagtctgctcccaccctgaccctttccgtagtgacatctggctctcagcttattgccctttcatgtaattttcataaatcctgatttagtttcctgattttctaaagagaaggtgaactggaatttgaagaaatacaggggcttaccaggctgggcgaatagcttaagtacaaagtcatggtgagtgttgagtcagtggggaccagcctgcccacaggagaaaattaaaagacncaaaanc

SEQ ID NO: 46137 - DNA, 1026 bp, Homo sapiens
cataaaagtgagaaagatcaagctggacttgagccactggccctcaggctcagcagggagctgcaggagaaggagaaagtgattgaagtcctgcaggccaagctggatgctcggtccctcacaccctccagcagccgtgccttgtctgactcccaccgctctcccagcagcacctctttcctgtctgatgagctggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaagcccattcaggtaccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggagtccatctgcatcaatgactgcctacgggagcaactggaacaccggctgacctctactgctcgtggaaggggatccacttctaacttctacagtcagggcctggagtccatacctcagctctgcaatgagaacagagtcctcagggaagaaaatcgaagacttcaggctcaactgagtcatgtttccagagcaagaagatttgagaggaaaggtcactgctgggggacgataacaaaagttaacagataagaaagagggcagaactactgagctaccattgcatgcttg

SEQ ID NO: 46138 - DNA, 347 bp, Homo sapiens
ggtccctaagtatatgtgggtgtccacagatgctgctagtcttgcctgatatttttggagttgccattttcatgtttcagagctcagagcaccgctgtcatccctaaggtggtttgcctcactataggagctgtctgcaagcaagaaaatgaacactgctaacagtgcttgtgcttggttctttccctgaaagcaagactctagccctggtacccctgggtaaacataagggcaggattccagttctctatagaacatcatacgttttctttcattcatgggttttatagattccatccatcattcgagtcattctgctgtgttgtcttctaaaccatcatcaacca

SEQ ID NO: 46139 - DNA, 1664 bp, Homo sapiens
cataaaagtgagaaagatcaagctggacttgagccactggccctcaggctcagcagggagctgcaggagaaggagaaagtgattgaagtcctgcaggccaagctggatgctcggtccctcacaccctccagcagccgtgccttgtctgactcccaccgctctcccagcagcacctctttcctgtctgatgagctggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaagcccattcaggtaccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggagtccatctgcatcaatgactgcctacgggagcaactggaacaccggctgacctctactgctcgtggaaggggatccacttctaacttctacagtcagggcctggagtccatacctcagctctgcaatgagaacagagtcctcagggaagaaaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagattcagctgtgtcccctccagtccgggatgttggtatgaattccccagctctggtcttccccagctctgcttcctctactcctggctcagaaacgcccataatcaacagagcaaatggttgggttggatattctcccagtaatgaagaccctcccaagccagagggggaagctacgaaggtcctgacaatagcatggctgccatgtccgccactgtcgacccacggcctagaagcagatgcggggcaagcgcgccaaagacgggcctgggacccggagtgacgcctgagccagcaaggcgccaaggctccacgacgcaggcgacgccaagaggaccacaggggagggcaaccacggggacaggacagaggaacacaaccaccgcacaccgcgccccaagccggcggacgcaacccggcccg

SEQ ID NO: 46140 - DNA, 862 bp, Homo sapiens
ctttccatctctgaagtcatagtttatgctgcacccctatgtggtctttcctgacgaccaggctctaccaccaactcaaaataatcagtcccttgctccttcctccaccctcaaggatccacatccacaaagaaaatgtgctacatatacactgatatggtttggctgtgtccccacccaaatcgcctcttgaattgtactcccataattcccgcgtgttgtgggagggagataatttgaatcatgggggcagtttcccccatactattgttgtggtagtgaataagtctcacaagatctgatggttttatcagggatttctgcttttgcatcttcctcattttctcttgccgccaccatgtaagaagtgcctttcacctcctgccatgattctgaggcctccccagccatgtggaactataagtccaattaaacctctttttcttcccggtctcagatatgtctttatcagcagtgtgaaaacagactaatacatgcaccatggaatactacacaggcatcaaaagaacatggcctttgcagcagtgtaggtggagctggaggccatcgtcctaagcaaattcacgtaggaacagaaaaccaaataccacatcttctcatttataagtgggagttaagtattgagcacacatggacataaatataggaccagcagacactgtggactactagagggtgtgtgggggggttaaaaacctatatatcaggtatatgctcactaccagggtgacaggagccgtactccaaaccccagcatcatgcaattttcctcagtaacaaatctgcacatggaccccctatacataaaataaaaattgaaataaaaatccacatcaaatac

SEQ ID NO: 46141 - DNA, 869 bp, Homo sapiens
agttgtttagtggagctacatgtttattaaccccttcctttctggtttaccctaaggaaatggcatctgctgtagcatcagttatcctcaagtagggaagaatattccctggctgcttgtttttggtcacaccatatcattaatacaattattttagtatttaaaaatgtttaaaagaacttgtgagaatgtatactcataaaatggaagagtggaatacatttaaacacgatattactgccattacatccttttaaaaccctgcaatgaatgtgttacattacaattgttgaaataactgttaagttctgtattttttcaacttggctgttctctccccacccctaaagaaaaaaaaaattgatcaggaataaagaccagatattcatagttattttcataacaaagacctaaggaaggtctgagtagcttgaaattttaaaaatatgaaacatcttttattttttcttactggagatattattcttcattcttccttgcccccctcctcacccaccctcacacataattgttggaagtaactggttactttttaagtagtgttacttcttgctgtggtactgggagaaatttaagctgccctggaatttcttttcccctgcttgggatccccagttgctctgcaaagtgatcgagcttgatggagcctgcacctgtgtcccgggaaggaagccgttgtaggcagctgtggaatgtctagttcccttcttccccaatgtaactgagagctgcttcaacatctgcacggttcagcaagtttgtcaagtttgtgccaacggctacagaggggatttttctagtaaaggccctaaaggtgtctcagagttagaggttttgtttgattaaat

SEQ ID NO: 46142 - DNA, 646 bp, Homo sapiens
  misc_feature (634)..(634): n is a, c, g, or t
agttgtttagtggagctacatgtttattaaccccttcctttctggtttaccctaaggaaatggcatctgctgtagcatcagttatcctcaagtagggaagaatattccctggctgcttgtttttggtcacaccatatcattaatacaattattttagtatttaaaaatgtttaaaagaacttgtgagaatgtatactcataaaatggaagagtggaatacatttaaacacgatattactgccattacatccttttaaaaccctgcaatgaatgtgttacattacaattgttgaaataactgttaagttctgtattttttcaacttggctgttctctccccacccctaaagaaaaaaaaaattgatcaggaataaagaccagatattcatagttattttcataacaaagacctaaggaaggtctgagtagcttgaaattttaaaaatatgaaacatcttttattttttcttactggagatattattcttcattcttccttgcccccctcctcacccaccctcacacataattgttggaagtaactggttactttttaagtagtgttacttcttgctgtggtactgggagaaatttaagctgccctggataacttgactatgaagaaaagagtgcntgcggtaccggc

SEQ ID NO: 46143 - DNA, 386 bp, Homo sapiens
aaccctgtctctactaaaaatacaaaaaattagccaggtgtggtgggatgcacctgtagtcccagctactcgggagactgaggcaggagaatggcatgaacccgggaggcagagcttgcagtgagccgaaatcatgccactgcactccagcctgggcaacagagcgagactccgtctcaaaaaataataataatacagaaaggcacctcccttccaaagtgataaataagtttttttgttttgttttgtttgtttgtttgttttgaaacagggtttcaccagtctctggctgttaagctcaagcaatccacctgtctcggctttccagagtgctggggcagctggatcacgaggtcaagagatcgagaccatcctagctaacacga

SEQ ID NO: 46144 - DNA, 5472 bp, Homo sapiens
gctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactgttcccagtgcagtgtttgacatccacgtggtctacgtcaccaccacggagatgtggctggactggaagagccctgacggtgcttccgagtatgtctaccatttagtcatagagtccaagcatggctctaaccacacaagcacgtatgacaaagcgattactctccagggcctgattccgggcaccttatataacatcaccatctctccagaagtggaccacgtctggggggaccccaactccactgcacagtacacacggcccagcaatgtgtccaacattgatgtaagtaccaacaccacagcagcaactttaagttggcagaactttgatgacgcctctcccacgtactcctactgccttcttattgagaaggctggaaattccagcaacgcaacacaagtagtcacggacattggaattactgacgctacagtcactgaattaatacctggctcatcatacacagtggagatctttgcacaagtaggggatgggatcaagtcactggaacctggccggaagtcattctgtacagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacagatccccctcctccagatggatcccctaatattacatctgtcagtcacaattcagtaaaggtcaagttcagtggatttgaagccagccacggacccatcaaagcctatgctgtcattctcaccaccggggaagctggtcacccttctgcagatgtcctgaaatacacgtatgacgatttcaaaaagggagcctcagatacttatgtgacatacctcataagaacagaagaaaagggacgttctcagagcttgtctgaagttttgaaatatgaaattgacgttgggaatgagtcaaccacacttggttattacaatgggaagctggaacctctgggctcctaccgggcttgtgtggctggcttcaccaacattaccttccaccctcaaaacaaggggctcattgatggggctgagagctatgtgtccttcagtcgctactcagatgctgtttccttgccccaggatccaggtgtcatctgtggagcggtttttggctgtatctttggtgccctggttattgtgactgtgggaggcttcatcttctggagaaagaagaggaaagatgcaaagaataatgaagtgtccttttctcaaattaaacctaaaaaatctaagttaatcagagtggagaattttgaggcctacttcaagaagcagcaagctgactccaactgtgggttcgcagaggaatacgaagatctgaagcttgttggaattagtcaacctaaatatgcagcagaactggctgagaatagaggaaagaatcgctataataatgttctgccctatgatatttcccgtgtcaaactttcggtccagacccattcaacggatgactacatcaatgccaactacatgcctggctaccactccaagaaagattttattgccacacaaggacctttaccgaacactttgaaagatttttggcgtatggtttgggagaaaaatgtatatgccatcattatgttgactaaatgtgttgaacagggaagaaccaaatgtgaggagtattggccctccaagcaggctcaggactatggagacataactgtggcaatgacatcagaaattgttcttccggaatggaccatcagagatttcacagtgaaaaatatccagacaagtgagagtcaccctctgagacagttccatttcacctcctggccagaccacggtgttcccgacaccactgacctgctcatcaacttccggtacctcgttcgtgactacatgaagcagagtcctcccgaatcgccgattctggtgcattgcagtgctggggtcggaaggacgggcactttcattgccattgatcgtctcatctaccagatagagaatgagaacaccgtggatgtgtatgggattgtgtatgaccttcgaatgcataggcctttaatggtgcagacagaggaccagtatgttttcctcaatcagtgtgttttggatattgtcagatcccagaaagactcaaaagtagatcttatctaccagaacacaactgcaatgacaatctatgaaaaccttgcgcccgtgaccacatttggaaagaccaatggttacatcgcctaattccaaaggaataacctttctggagtgaaccagaccgtcgcacccacagcgaaggcacatgccccgatgtcgacatgtttttatatgtctaatatcttaattctttgttctgttttgtgagaactaattttgagggcatgaagctgcatatgatagatgacaaattggggctgtcgggggctgtggatgggtggggagcaaatcatctgcattcctgatgaccaatgggatgaggtcactttttttttttttcccccttgaggattgtggaaaaccaggaaaagggagctatgatttttttttccaaaacaatttcttttttaaaaaagactattttatatgattcacatgctaaagccaggattgtgttgggttgaatatattttaagtatcagaggtctatttttacctactgtgtcttggaatctagccgatggaaaatacctaattgtggatgatgattgcgcagggaggggtacgtggcacctcttccgaatgggttttctatttgaacatgtgccttttctgaattatgcttccacaggcaaaactcagtagagatctatatttttgtactgaatctcataattggaatatacggaatatttaaacagtagcttagcatcagaggtttgcttcctcagtaacatttctgttctcatttgatcaggggaggcctctttgccccggccccgcttcccctgcccccgtgtagatttgtgctccattttttcttcccttttccctcccagttttctccaaagactcttctgttggcaacattttcaacccattggttgggtgagaatggcgactcaaatatcaccttgagaatttctgtgggtgggaatgggagaagcagaggaatcctacagtggcagaaatccttttcttgtccctgtattatcctttttctcatgtctgtatttggtatgaaggattatttaaaggtgcaata

SEQ ID NO: 46145 - DNA, 2193 bp, Homo sapiens
gctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggtaagcaaataggcttttctgttaaaccatcatgtttcttaaaggaaatcagtataattaataaacataatgtttcca

SEQ ID NO: 46146 - DNA, 421 bp, Homo sapiens
tatctcgggcctgaagccaggggttcaatacaacatcaacccgtatcttctacaatcaaataagacaaagggagaccccttgggcacagaaggtggcttgggtgagttacaaagggtaccttccgtctcccttactggttcttactttcagtaactaaatgttctaaaaaataaattgctcttccatgtgtatggagatttagaatttataaagggcttttcctccacattttagtttgatcccccacctgcatgaggaaggaaggaaacgtgttctgattttacaggggaacacattggggctgagaacagcaataggaattgaaactttttagagtctggcacccaggaaagttagaggcccctttagctttctatctaacagctgtgtcaacccaagttgggccttcagaggaactta

SEQ ID NO: 46147 - DNA, 388 bp, Homo sapiens
cccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactggtaagcataggcttttctgccagtcatgtttcttaaaggaaatcggtagaatttataaatgtcatgttttccaaatactgttcttcttttaattacctaagaaaatctttttaaaaatttttataaagatagtaatgcatattcattatat

SEQ ID NO: 46148 - DNA, 2245 bp, Homo sapiens
gctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcacccctagtccaattcctgacccttcagtagcaactgttgccacaggggaaaatggcataacgcagatcagcagtacagcagaatcctttcataaacagaatggaactggaacacctcaggtggaaacaaacaccagtgaggatggtgaaagctctggagccaacgatagtttaagaacacctgaacaaggatctaatgggactgatggggcatctcaaaaaactcccagtagcactgggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggatgatttgaacacctgcctggaattccatcatctgaaacagagttggcagataagaatggcccctatgccaaatttggctcattgtctgtttttgtaaataaagttttattggatcacagccatgttca

SEQ ID NO: 46149 - DNA, 2007 bp, Homo sapiens
gctcggagggggcgggggcagcggcgggcggcggcgaggggctgcggagctccgcagccgccgggccggccggggcgggaggaagcgatgaatattcagagggggaggggaagggagggggccgagcgctcgccgcggctccctgcagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggaggcgaaggagacggcaggaggcggcgacgacggtgcccgggctcgggcgcacggcggggcccgattcgcgcgtccggggcacgttccagggcgcgcggggcatgaagccggcggcgcgggaggcgcggctgcctccgcgctcgcccgggctgcgctgggcgctgccgctgctgctgctgctgctgcgcctgggccagatcctgtgcgcaggtggcggcccagtcctgtgtttgacattaaagctgtttccatcagtccaaccaatgtgatcttaacttggaaaagtaatgacacagctgcttctgagtacaagtatgtagtaaagcataagatggaaaatgagaagacaattactgttgtgcatcaaccatggtgtaacatcacaggcttacgtccagcgacttcatatgtattctccatcactccaggaataggcaatgagacttggggagatcccagagtcataaaagtcatcacagagccgatcccagtttctgatctccgtgttgccctcacgggtgtgaggaaggctgctctctcctggagcaatggcaatggcactgcctcctgccgggttcttcttgaaagcattggaagccatgaggagttgactcaagactcaagacttcaggtcaatatctcgggcctgaagccaggggttcaatacaacatcaacccgtatcttctacaatcaaataagacaaagggagaccccttgggcacagaaggtggcttggatgccagcaatacagagagaagccgggcagggagccccaccgcccctgtgcatgatgagtccctcgtgggacctgtggacccatcctccggccagcagtcccgagacacggaagtcctgcttgtcgggttagagcctggcacccgatacaatgccaccgtttattcccaagcagcgaatggcacagaaggacagccccaggccatagagttcaggacaaatgctattcaggtttttgacgtcaccgctgtgaacatcagtgccacaagcctgaccctgatctggaaagtcagcgataacgagtcgtcatctaactatacctacaagatacatgtggcgggggagacagattcttccaatctcaacgtcagtgagcctcgcgctgtcatccccggactccgctccagcaccttctacaacatcacagtgtgtcctgtcctaggtgacatcgagggcacgccgggcttcctccaagtgcacaccccccctgttccagtttctgacttccgagtgacagtggtcagcacgacggagatcggcttagcatggagcagccatgatgcagaatcatttcagatgcatatcacacaggagggagctggcaattctcgggtagaaataaccaccaaccaaagtattatcattggtggcttgttccctggaaccaagtattgctttgaaatagttccaaaaggaccaaatgggactgaaggggcatctcggacagtttgcaatagaactggatgatttgaacacctgcctggaattccatcatctgaaacagagttggcagataagaatggcccctatgccaaatttggctcattgtctgtttttgtaaataaagttttattggatcacagccatgttca

SEQ ID NO: 46150 - DNA, 522 bp, Homo sapiens
ctcatgctgtgctgtacttgctttgcagatcctgcgtccatggcctccttcgactgcgaagtggtccccaaagagccagccctggttctcaaatggacctgccctcctggcgccaatgcaggctttgagctggaggtcagcagtggagcctggaacaatgcgacccacctggagagctgctcctctgagaatggcactgagtatagaacggaagtcacgtatttgaatttttctacctcgtacaacatcagcatcaccactgtgtcctgtggaaagatggcagcccccacccggaacacctgcactactggcatcacaggtgggctacaaggcaggggctggtcagttggcactgtgatcactcctggagcggctgacccacagtgggtctgcacgtgtggactagaaatctgtttttgtttttttatttcccctaaaatatttgcttttactgacatagactggtttctcattctatagaaatcaatctaaaaaagcagagtaagaggggctcatttttta

SEQ ID NO: 46151 - DNA, 330 bp, Homo sapiens
ccgaggcaggcagatcacttgaggtcaggagttggagaccagcctggccaacacagtgaaaccccgcctctactaaaaatacaaaaattagctgggcatggtggtgggtgcctgtaatcccagctacttgagaggctgagacaggagaattgcttgaactcaggaggtggaggttgcagtgagccgagatcatgccattgcactccagcctgggcaacaagaacgaaactctgtctcaagaaaaaaaaagagacaatctaaaagatattctagtagtctatatgtgtggtgataaagccctaaactaaatacatcatttctgaaaacagc

SEQ ID NO: 46152 - DNA, 365 bp, Homo sapiens
catcacatagctgttgacctacattggcatctacccttacctgctttcactacccatgctcttgagataaaaagagcttattctagtcaagaccaacactccagctggattcttgacctcatcctctctctattctcccaggacattcctctgtcacttaatctctctgtttcctagatctttaacatctctctcagcctatgagacagtttgccttgctccctcccattttgaaaaaaaacaaaaacaaacttgtcttgatctgcatcctccaaatatacatctctaatcttgttctctaccctgcacttcacttggatgccctacagatatatttcaattcaacatgtccagaattaaattcc

SEQ ID NO: 46153 - DNA, 134 bp, Homo sapiens
ataccactttctttacatattaaagcataatttatgttttttgatgcagtgcatataatttttatgaagttttcaatttaggatattacttcttttttgatttggaaaaaatagttataggtaagggcagaaga

SEQ ID NO: 46154 - DNA, 640 bp, Homo sapiens
gcctggctttgacttaatttttatatatggtatgaggtaaggatccagcttcattttattgtggatacccagttgtcccagcacagtttgtttaaaaaaaaaactgttctttcctcactgaatgatcttggcactcttgtcaaaaacaagttgactatagatgaatgggtttgtttctggactcttgactctgtcccttgcatctctatgcctgtccttctgacagtgtcactcagtcttgattactctggcttattaggacgtcttggaatcaggaagtgtctattcactctcctaaccctgtttcttcttttctctcttcttcccttctctccttttatcttttgtgcaatctttagggcaagggattacaagtgtttgttgtaaagggccagatagtaaatattttatgtctttgtaggccgtgcagcctccatctcagatgcaactctgttcttacagagtcaaggcagccataggctatatgtaatgaatggatgtgactgtgtgtttttttgtttttttttttttgatatagggtctcaggctgtcacccagacccaggctggagcgcagtggcacaatcatggctcagtgtagctgctaccacctggactcaagtgatcctcccacctcaacc

SEQ ID NO: 46155 - DNA, 845 bp, Homo sapiens
  misc_feature (845)..(845): n is a, c, g, or t
aagtaagatgaaagtttaggattactccattcattcttgcttgtattatgtcactgaggaaatagtttctttcttttttaaaaaattagaaagaatttactagcattttacttgctagaactttgccagaaaaatcactctttttaacaatttaaatcagcaattagaccaaaaaaatactttgggtggaatgcttttcttttctatatgtttgctatgggttgaggttatatctgagccagtttcattatctccctaaaacagaccacctgaatttagcagttgaaattcaatcagtttttaaaaattacattgcagaaccaaacttcttaatctcaaataaattactgaattaagccatgataattacattatttgtcccttcctgtcttttaaaaaataaaatgtacatatggacgtttttgtttcagaattgcttttgttttaaaatgaaaatactttatcttatagactatcttttaaaaagtattctaaggcaatgaaaatctaggaattccacccacacataggttcatcccctcctgtactttcattctttttagtaataccacaggaaatataaataccacagccaatcttaacctgcccctcatttaattaaatattatactagcatttaccatctcacttctaaggactactagtatatcggtcacaccttaaaatcttcctaatatgctagaaggataaaacaaacgggatataggtaattcataaactcaaagcattctcttggcaatatgggtatggccaaaattgcggcggagaagggggccccacattgtatccacaatgtggaggttcacacacggagatgccatttn

SEQ ID NO: 46156 - DNA, 813 bp, Homo sapiens
aagtaagatgaaagtttaggattactccattcattcttgcttgtattatgtcactgaggaaatagtttctttcttttttaaaaaattagaaagaatttactagcattttacttgctagaactttgccagaaaaatcactctttttaacaatttaaatcagcaattagaccaaaaaaatactttgggtggaatgcttttcttttctatatgtttgctatgggttgaggttatatctgagccagtttcattatctccctaaaacagaccacctgaatttagcagttgaaattcaatcagtttttaaaaattacattgcagaaccaaacttcttaatctcaaataaattactgaattaagccatgataattacattatttgtcccttcctgtcttttaaaaaataaaatgtacatatggacgtttttgtttcagaattgcttttgttttaaaatgaaaatactttatcttatagactatcttttaaaaagtattctaaggcaatgaaaatctaggaattccacccacacataggttcatcccctcctgtactttcattctttttagtaataccacaggaaatataaataccacagccaatcttaacctgcccctctccatttcttctttatggcctttggttcttcacttggtattacaaagtactgtgtcttttgggaaccttagttatagacaccagaaatggttttgttctaaattgccacttgcacccaaagcaataggaaaccctttctgggagacaaagaagtctgtgctgagacttttggccactggatgccactgttgatccagcaga

SEQ ID NO: 46157 - DNA, 321 bp, Homo sapiens
atgaaactaaaatatttctctggttccatggaacctaatcacccttcaaaattaaaagatgcctttatttcaaatatttctatagctggggtcattaaaacttaaaaatttgtaaagcataacttgtaacccaaaatgtaagtattagatattgagcattatataaatgttttaatgttttaatttttaagtttttagagatgggggtcttgccatgttttccaggctggcctcaaacatctgggccctagcagttctcctatctcagccttctgagtagctgggactacaggtgtgtgccgctgtgcctgactatacaga

SEQ ID NO: 46158 - DNA, 1587 bp, Homo sapiens
  misc_feature (1026)..(1026): n is a, c, g, or t
aatacaagtggatttgttaaatggcttttccctagatgaagtaggtcaaactcgggcctgcatctccctaaggaggcaataatgcctggtagcattaccagagggtaagacggagaagtactttggagaaattagaaacttccctagtacttgttatgaaagctcaaactctttaaaataatggaaatgtcataaatcaggcagattcacttttgcctgaggatggcttgaaggaggctgctgtgagctctttagtgatttgtctgacacaggctacaggcaaatttaaaggtgaccaacttagcaagaaacaaggcaattgaaagatcggtttcctaccttgaccagctaatgcctgcaagagcagaccgaatggctgaattccaacccgattccaggaatactgtttgctgacctgctgtcttaagtcagtgctgtgattcctgcaaaagacggcagagtcagggtggggaaatgagcaggtgctgctgttggcggtgggtctaaacaccccaccacacatttgtttgcatcacttgtccaggactatgattctggcactattttcctggatgttatacaatgtcaaaggggaaggtggatggttcccaccaagacagaagcaccttcttatttcagatgctatcttcttggtctgctgtgctgtgtaacaaaaatgtatcaaccccaagcagagttaaggccagagctgggatgctgtggtaggctgaaaaacaccctggaaaagatatccatgtcctaatccctggaaccattgaatgtttccttatatggaaaaaatgtggggagcctttgctaatgtgattaaattaaggatcctgagatcgtgacggggcggttattctggattccccaggtgggctctaaatgcaatcactggcatctttgtaaaaggaaggcagagggagattatttcacatccatagaggaggaggttgtattagttcgttctcacactgctataaagacactacccaagactgggtaatttacaaacaaaggagntttagttgactcacagttccacatggctggggaagcctcatgaaacatacaatcatggcagaaggggaagcaggcatgtcttacatggcagcaggcgagagagagagagagagagagagagagagagagagagaggaaaaactgccttataaaaccatcagagcttgtgagaactcactcactatcatgaaaacagcatgagggacaccgcccccatgatccaatcaccttccacctcatccctcccttgacaggtggggattatggggattacaatttgagatgagatttgggtggggacacggacccaaaccatatcagaggtcatatgacgacggagcagagaaacaactgaagatgctggccttgaaaactaaagtggcatggccacaagccaaggaatgccagcagtcagcagaaagcagaagaggcaagacacagagtctaccctatagcctcctgagaaagctcagtgttgctgacaccttgagtttgacccagtgatgctgatgtctgacttctggcttccagaactgtgagagaataaatttccgtcatttt

SEQ ID NO: 46159 - DNA, 356 bp, Homo sapiens
ttgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtagagagagagagagagacacacgggttcttgctatggtgcccaggctggtatagcactcctactctcgagagatcttcctgtcttagcctcccaaagtgctgaaattacaggcatgagccatcatgcctggctcactggaaaaatttaaagttcatccatggtatgtctaaaagaatctcacacagtgtactgggccatattatttgtgagatgctgtagtggt

SEQ ID NO: 46160 - DNA, 419 bp, Homo sapiens
gcagtgccctatccagaatgcatgtcccatgggtcaaattaatttcagataaccaaaaacttcatgtcccctgtggttccttttggggttgacgttttgggggctgtttccatgtctgacttggcaccactgcccgacacgtagctggaaaccatgacctatatataggcctgcactgcccggcatttcttttgttcttattcttttacttggtaaacacattttttttttcatttacgtcgggatttctcagattttgaagcatgagagggagaatgtatctatttacaataatgaggaaaattaagaatcttaaatctttatgtaaatcagtaaacattctttactaacctttgatttattaagaagtttcttctgaatgaataaagcacttttgttattagttaaaatatatacga

SEQ ID NO: 46161 - DNA, 243 bp, Homo sapiens
gagcatctactacgtgccaagcattgtgctaatggatggggatacaaaaataagtaatatatggttgttaccctcaaggggctctccctggagatgggtagagaagcaaattatgcaaaactcagagcatggtgatttatcaggtgctacaacagtgggagaaactggagctttgagatcccataaaacaggtgctttaatatctggaaattggctttgaagctctacttaaatatatccact

SEQ ID NO: 46162 - DNA, 1142 bp, Homo sapiens
agcgagactccgtctcaaaaaataaaaaaagaaaaaaggaaaaggctttgatcctacattttaaaattggcaaatgaatgtacatttacataagttgaaataaagtttaaggtttgtatgaatggtttttaattatttcctgctttaactattcttttccattaaatgaccaaccactggtaccagtggattggataagacagttggcactgcgtggataaaggaggtttaaagaaaaggaaacatgaaatgccttctttttgaggctgctacaataaccaagttacaagtgtgctgattaatttattattcctgtttccagaaatgtcttatttgtatttcatttttaatatttttaaatttaatagtttacatttcccccactagtgttgccttctatttgtagcaagttaatactggttttctatttataatagtgagataaagtttcctttggaaaggaatgttacctttaaagaaaaacattaggtgactaataatttggtgcttatgtgactgtggcaaatcatgaagatagtattttaagtatggaaaacaattgctaaccagcaagataatgtcaagttccttaatatgaactcacttcttggcctttgtctaccttctccagcttcatgtcttaccactttcccttattatggacttcatgttgatcaagtggaggctccctctcctcaaggagagtccctaggccagattcagaagatggttggtagagaggggatttgatagcttctgaggacagtgctttggatgggagaaatatcatgcaacttaggacagtgctttggatggaggaatatcatggaactttagttttccagctttattgagctttgccctgtgatattcacttgtttggggggctgtttggagacagggtctcactacattgtccagacacaatcaccatgtactgcagccttgaagtcctgggcttaagtgatcctcccatttcagcctcccaactagctggaactacaggctcgagccactgtgcctgactcttactcacttttttgttcccaatacctggaagaagatcgtcagtctgtaaatatttgaaatctaaataagggttatggtgctgtagtataaggccaaatcttgggcaccaaaca

SEQ ID NO: 46163 - DNA, 491 bp, Homo sapiens
gaaatagtggaaaaaataaataataagtagctctttgtgatgccaattttgtgtgtccaattgatggggccacaggaaacccagatgtctgatgaaaaattactttgtgtgtgtgtgtgtgtgtctgtgtgtgtgtgtgtgtgtctgtgagggtgttttcggatgagattaaaatttgaattggcggattgagtacagcagattgccttccctaatgtgaatgggactcacgcaatcggttgggggcctgagtggaaccagaagggtgactctcctggaagtaaagaggaattcttcctgtctgactgcctttgaacacatacatatatgacattattttagaggcaggtatgcaggcatattccaggatatgtagggtgacctggaaaactggagacccagtagagctgatggtttagctctagtcaaaaggctggcaggctggagatccaggaagagcaatgcttcagtttgagtctgcaggcaggaat

SEQ ID NO: 46164 - DNA, 596 bp, Homo sapiens
  misc_feature (590)..(593): n is a, c, g, or t
  misc_feature (595)..(596): n is a, c, g, or t
aaaggactgtggaacatctcagagcctctcagtagtagcagaaaagttactggggagtacagatgcatgtatgtgatctgcagaagctggtcaggatccaacttgcatttactacatttccatggatgttcagttgccatcttctgcctactcctgagctttcatccaagagaaatcagtgtttgctttacaagacttccggttgtctaacccaaatgccaattttatatgggcaccctgccactcttctaaaagactacattttgcaggcaattttgcaaccaggaaagaagattcaaggaggaactgaaatacagagaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaatttcaaatataaannnnann

SEQ ID NO: 46165 - DNA, 510 bp, Homo sapiens
aactcgtcatcccggattagacaaataaatgaaaaaaaaaaaaacttttagacttccggttgtctaacccaaatgccaattttatatgggcaccctgccactcttctaaaagactacattttgcaggcaattttgcaaccaggtaacttcattctggtcaacgagatttaagcaaagtgttttgtgggactttaggaaagcctccttaaatgggaaaaggaaagaagattcaaggaggaactgaaatacagagaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaa

SEQ ID NO: 46166 - DNA, 320 bp, Homo sapiens
  misc_feature (12)..(13): n is a, c, g, or t
gcttcccggagnnaagacaccatcatgtggaaagaagattcaaggaggaactgaaatacagagaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaa

SEQ ID NO: 46167 - DNA, 849 bp, Homo sapiens
  misc_feature (43)..(43): n is a, c, g, or t
  misc_feature (841)..(841): n is a, c, g, or t
aaaccaccaaaaccacactacaaactacaacacaaacacaaangtgctaggaacaccaggaggtttgaagacaaacaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaaccacaactcaataattgataacttaacccttgcacacactataagcacacccctcccccacaatcccccccagcaaaaaatcatcaccacctgtcccgtatacccgcctatgcttcaccctctccgcccttcccctccccccccccgttcccacactgaccccaacacccaccaccgcccacactacacgccccccctccatcgacgtcccccgcgccgcgcatactatcctacccacccaatccctcaccacattgaaactgcacctcaaaacctctctcacccctcctcacatactgccttccctccccctcccctcacctgcttttcccagccgcgaacgaaaccaaaacaagtcctcccgcgcaccaatgaccccagcatcacctctctctctccagaccctcttctactattatattatctccctctattcagcaccaccaatacccatctatgcccctaccccctctccccataactccctcacacccccccctcaccactntccccgtt

SEQ ID NO: 46168 - DNA, 423 bp, Homo sapiens
  misc_feature (12)..(13): n is a, c, g, or t
  misc_feature (324)..(325): n is a, c, g, or t
  misc_feature (359)..(359): n is a, c, g, or t
  misc_feature (376)..(377): n is a, c, g, or t
  misc_feature (382)..(382): n is a, c, g, or t
  misc_feature (392)..(392): n is a, c, g, or t
gcttcccggagnnaagacaccatcatgtggaaagaagattcaaggaggaactgaaatacagagaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaatccnnccccccgcggggcccgcgcccaccccccccccancaaaaacccacaaaaannaaccnaaaaaaagtntgcggggggaggaggaaaagaaggggggcgg

SEQ ID NO: 46169 - DNA, 576 bp, Homo sapiens
aaaggactgtggaacatctcagagcctctcagtagtagcagaaaagttactggggagtacagatgcatgtatgtgatctgcagaagctggtcaggatccaacttgcatttactacatttccatggatgttcagttgccatcttctgcctactcctgagctttcatccaagagaaatcagtgtttgctttacaagacttccggttgtctaacccaaatgccaattttatatgggcaccctgccactcttctaaaagactacattttgcaggcaattttgcaaccaggaaagaagattcaaggaggaactgaaatacagagaggctcctttgcaaaccagtatcaaacagatgccagtcacttgtaacatctgccctaccattggaataacataatgagaggcctgggcaacccagagagaagtgtaaatgacatcagttactaataagaacactgctgaattttgaaaaacttttgcatgctttaatttctccatattttaagtaattatactaattatgagagtgctgtgtattattagttgtttggtcacaaataaaaacaaaattcatttcaaa

SEQ ID NO: 46170 - DNA, 465 bp, Homo sapiens
aatattatagcaatggtctcatcacagtttcatctttgaggatgaacaatatctattgtaatagctcgctgttaactatgaacccatggtatgtaggcttctccctggggtatgtggtaatccacatctgtcatatcttagtgcccagcctgttgttcctagcacccagtttgggtactggtaaagcttggtgactttaggcctaagagagacctaaaatgggtggcctactgacagttccaggtgacagccatggtctgaggatgtgggtgatatgataggaaaaaatgtgggcttcacatacaaatgggcataggttcaaatcccagatctacttattctttgacgttgaaaacattacttaattctgagtctgcttctttaagacaaagatgatgagattagccttagagaaatattagagaaaggttaacttagatgatagaggtggaagataaaatggct

SEQ ID NO: 46171 - DNA, 451 bp, Homo sapiens
tctcaatggcttgctggctttcttcttgggtttcttttcattcctggtaagtaattgtgctagaaatgggccacagtcactaggaaattgtctcttagggtcatccatgcatcataggactggatgggagggaacctggtaggtaggtaggtctgctaaagtgtttgcctgtcgttcagtaattttagatgttactgcttagaaaaagagatagaaaagaataatattgactgctaagatctacacatggggagtagggcttttattctaaaaattttgaattattgaaatccagcacaaatgtgatgcataatttttatcccaaaataaaattgtgttttcatttgtgcatgtcacctgctagttcttgtgatgtggacatttttttaacctatttagagtattatcatgaatattttaaattttcacctaaatttacgtatcagagatt

SEQ ID NO: 46172 - DNA, 178 bp, Homo sapiens
ggctttctatgtgtaaaagacaccactcatcaatatatgatatcgcagctctactctgttaggtatacacatttatatagaagagaaagaggggattatgtgagctgtagagatgtttcagacttgggggaaaaaaaaagtctatgaaccagataattcaaaggcagaggagggtgtc

SEQ ID NO: 46173 - DNA, 3376 bp, Homo sapiens
  misc_feature (1366)..(1366): n is a, c, g, or t
acggcccactctgctgagcaaggtgactgcaggctgcttgttctgaggcctgccttctttaacgtgattacagcgtgcactttagtacaagttcgacaattctttttaataagcttcataattagtgttgggatgcctcattacaagtcatagcctgtagcggtcctaggccacacagccctctgcaatctgatttattttttatcaggcagcaggagctgtctggagtttttgtttgtataatggtggcctgcattaggcccccagtgtaaaaataccaccaggaaattaattgcttctgtgtggattcaccacagatgtgtcctgttgatcagaatagtgtatttttgactttgctgtcctgcagtgaattgtaaaaaaataaaatgaaacccagcaatgcaaacatattagcatccatgtagattcaggaggcatcattgaaaacatggggcttcaaaggaggatgtccagggcaggttcgagattctggtaagacttttttccttcctttcccttttctcacagctcttatttgataagaaacccatgtatttttgtattgcctgtaaaggaaacctctccatgaaaagcacagggccagagtctcagttggtttctggctgaaagattactcacgataaatacaccccagcagagtggctgatttccccgacacccacccccggcatcgagacctctgcaagcttcagcagacgagggcctgtctccagcgtgcctcccggccaccccagagggaacacaggtggatgctcggcggccggccttgtggactcttcgagggtggcgtgtgtgtgccacatatttccccgtcagaccctggtttcccctcattgctccctgggctaagacagaaatacatgccaaaggcttccttccttccgtctctttgctcttgcatcacgccacttgcccagttcctgaattctgattaggttgtgaattgcacctccagctttgaacacttacaggatttttttttttcaatcttagtccctgaattagaatgtgttacttctgtgttctcttcccagcactggacaggtcgttgttggtgcttccgtgtggatggatcacatcccgagggtggacattttgctcctgtattcctttgtttgttctttttcatccaggagtttttatcattctccttgtccttctcttttgaactctcctgtggtcagctgtctgctttccttgctcagcacggtgttgggatggggtttgtaaatttaatttcagataacatcttgtttgtgaaaaaaagaaaactaaagatcagtgtaacaataatagtgaagcatatggaataaaactaaagatcagtgtaacaataatagcgaancatatggaattgtgaaggaaaataaataggtttagtatacacaagaacatattgctctgatggttttattttattttatatttgttttttctctgactttaaatgctcctaaagacacatttggcatttttgcgccagtagcaaggatgtgcagagatgtattggtggaagaattctagtggttccctattaaaattctataacttgccgtattaccagtaaacgtgagctgccagagcctacaggtaggcaagggctcccagaaggagaggcatgaggaaaccttgccaagaaggcaggggaagccccagtggtcactcccacatggcattcagacggagggtcctccagcatcgtgggctcaagagttgtccaagtgtgtgttcgtgtgtgtgtggtgtgtgtgtgagagagagagagagcacgctagctctcaggatggggatgttggggaggaggcctagaactgggtttctccctctgtgtaatctactctctctttatcctcctcccagatacctctcaccctcgggagaagactcttagagaagcttgttacaaatgcatattcctcagccaccccctcctgaattcctgtttcagcaggagtggagcgggcccaggaatgtgcattttaaatcaggatcattctgaagctgaaggtgtagcctaggcttcgaccctaagctgcgttaaatgacttcttgctagagaagaccccactaaaagagtccagtgtcacccgccctggtttattaacacttgaactgggatgggaaggttttaacttattgcagagccaaacaaattaatctttaatggtgagcattgcttctgctcaccaagggaggggacctctgggagctctctgcagtgctcccctggccagctcctgggggaggggcctggtcactgtgaacacattctggttgtgcagaacccacggcgacaacagatcttcgctgatgtcctactgtgtccatggacgtcagggccatttatcaattcccagcagttaaaaaggggataatgaaatgttgcctgatccccaacttatagctggaaccgaaatgcatggcagattcatttgtcagccagcagcagcggtggcattttgggctctgtattctagggacagttcattccaagggtcttctctgcaatggagggccgctgattatttgtgacataattaacctttactcatgcacattttcctttttactattcatgcagttgctaattccaaaagtagatggcagttgtccaagacgtaatgaaatggatgccgtgagtgagagtctctcatttggtgaacgaggctgcggacccttgatagaaagtccacattgaaggaagcccccagtgaaaggaataataaaataattgtaataataaaatactggggaataacaaaatgttgttgagtacagtgttgtgaatgagacctgagtgctgaccccaggtggcctccaaggtaggacaaggaacacaaaacccaggagacctttccagggaaaaaaagcaaaaagatcaccacacccaagacacttgctttcctcttcatttttcctccctctgtcacccacgtagaaaaataaagatagaaaagagtttcttagccaagtttgaaaccagcctaatttacatggactgatgttcattttatcttgggcaatacttctaagaaggaagattttttttgactttgttaagaaaggtggctgggcacaagggctcacgcctgtaatctcagcactttgggaggccaaggcaggcatatcacttgagccgaggcggacgtttttgagatcagcctgggcaacatggtgaaacctcgtctctactaaaaatataaaaattagcagggcatggtggtgcatgccagtaattccagctacttgggaggttgaggcaggagaatcccttgaacctgggaggtacaggttgcagtgagcccagatagccccactgcactccagcctgggtgacagagggagactccatctc

SEQ ID NO: 46174 - DNA, 385 bp, Homo sapiens
ccagtgttttttgacagagagggagaataaggtatggtcttagaggccctgctaaaggattttgtttatattcacagtgcaatgagaaaccattcaaggatttaagcagggaagtaaaattaagtaattaaatttttaaaagaccactttgatttctcactacaaaacaaattgcagaaagcaacactgaaagcagcaagacaattaagagtctgttgaattgacagataagagatgctggtgattaggacaaggatggtggccgcggaaacagagagagggctcccacaaaattcatgtattgaagccttcaattactgcctcacatatggcctgtgaggagggaattgaagataaatgaggtcagaaaggtggggtcctaatt

SEQ ID NO: 46175 - DNA, 1351 bp, Homo sapiens
agaccttgcagatctgaaaatgtctttcttctagtctcatacttgattgataatttagctatgtttgtgcattccaagttggaattcacttttcttcagaattttgagaacatcactctgttctgggtctcaaccttggctgcagaatgattggaatcatctggagaattttaagaattatgaatgtctgggccccaccactagagattctgattcaattaatcaaacctttttgaagcatctagtggattctgttgtgcagctccagggtgggtattgaggcctcttgccattccgattgctcagctatagctggagatttgttcctccctcaatctccccctcaatctttttttaaaaaattgttgatgttgtattactggatgtttgaaaatttcactgaacattggtatgaattttttttttttgttcattgtgctgggcactaggtgaactctttttccatctagaaacttattcttcatttgagaaattttcttgtgtttaaaaagaaattattcctccattttttctggaattcttattagctgagtgttggagcctctggactgatgatctgattatcttataatttctcttctatttttgtctctgccattttattttattttctaggaaatttctttattatccagtgaatttttatttgttataattttatttccaagttatcttctatatggatgttcatttttatagcaatcattcttttaagtatgcagtattttttcacctctgaagctatttaagtttttaatgtgtttttagctccctgcattttttgttattctgttgtcattcacattagaggccttcctcaagcattctgtgactcttggctgtgaattcatatttaaaagtaagtgccttaaacacttactagaagctggagttgagagcttgttaactggtctccccttgaagggtgtttgtagggggaccctaatcatgtgcacgtgtgtgtagtactcagttttaaaatttaattatgaaattttaaaaaattgtttttcattttttgtatgagtttctgaaccattttttaaaaccattattttggtatactttacacttacagaaaagttgaaaaatagaataaggggctgggtgtggtggctcatacctgtaatcccaacactttgggaagttgagtcaagaggatcacttgaggccaagagttcaagaccagcctgggcaacacagtgagacttcgtctttacaaaatataaaaaagttagctggctgtggtggcacatacctacagtctcaattacacgggaggctgagcagaaggatcacttaagcttagggatatcctgtctcacaaaaa

SEQ ID NO: 46176 - DNA, 283 bp, Homo sapiens
  misc_feature (1)..(1): n is a, c, g, or t
  misc_feature (47)..(47): n is a, c, g, or t
ncaaaacaaaagggcaaggagaaacgaaagcagacatgaaagagaanccgaaagtcaggcccggccacggtggcacgcctgtaaatcccagcacgggaggccgaggctggtggatcacttgaggccaagagttcaagaccagcctgggcaacacagtgagacttcgtctttacaaaatataaaaaagttagctggctgtggtggcacatacctacagtctcaattacacgggaggctgagcagaaggatcacttaagcttagggatatcctgtctcacaaaaa

SEQ ID NO: 46177 - DNA, 854 bp, Homo sapiens
ccacagggtttctctttgccttctctcattctatatttgtgtttccttcaactacagtgagcattctggctcctagcaacattcatatatttcctcatttgcatggtcccacaatatatacaaaatactttcagaattgatacacgcatgcaatgaaagaaaataacctacaaagtagttaaattttttttgcattgtttgtttgtaaacagaagttatttagtcaaagtactgtgttcaagagttattctgacccccttcagagcagttatattatttatttgaaatcagttttgcctacttttgagtttcatattattattcttaaagatttacttatgttgtgaatatcaatatttccccccactgctgtaaagcagcagtccccaacctttttggcactaggggccggtttcctggaagaggtggggatgggatggtttcgggatgaaactgttccacctcagatcaccaggcattagttagagtctcataaggattgcgcagcctagatccctcccacgcggagttcacaatagggtttgtgctcatatgagaatctaatgccaccgctgatctgacaggaggcggagctcagatggtaatgtgagcgatgggaagcagccgtaaatacagatgaagcttcgctcccttgcctgctgcttacctcctgctgtgtggcctggttcctaacaggccgtggaattttaccagtctgcagcctaggggttggggacccctgctgtaaagtattctgaatgaactacactgtatccattatactgatgatgaatatttgtgttatttcatatttttattatgaataaaactgctatgaacatgcttgtacatgc

SEQ ID NO: 46178 - DNA, 265 bp, Homo sapiens
tctctctctatatatatatatacatatatatatatacacacacacacacacaggtaatatatatgcatacagacatatatacacacacaaatatatgtatgatatatgaaattatttttccagaaccattggagaataaattgcaaacaggatgaaattgtatctctaaatacttaagtatgtgtttcctaaaacaagaatattgtattctcttgtataacagtagcacaattataaaataaaaataataacattgatataataa

SEQ ID NO: 46179 - DNA, 427 bp, Homo sapiens
gagggatctacctcattctgggcctcaaagaattctcacaaatgaaattcccaaggaaaataaactgcccccttgtcaaaaataaacatacaatacacaaaactccgcaatcaagaaaaagatcagcaaggatttcaaataacagaattatcagataggctataaaatgaatatgtttaatacatttaaagaaaatcaaatataagcttgaaaatatgcgaaagggataggacactgtgaagaataagaaagcaagttttaaaagcaaatatgccttctagtaatataaaagtgattattgaaatttaaaactcagcatgtgggtttatcagcagtaagatgcagccaaaaggagaagtaatgaattaaagacagatcacttcaacaaggacactttactgcttttccccattagaaagatctccaa

SEQ ID NO: 46180 - DNA, 797 bp, Homo sapiens
gatgaaaacaagtgaccctagaaaataatttgaatccatttgaaaaaaagcaaagaacaagggtaaatgtaattaagtaattaaaaaagacagtaaaggcccggtgtggtggctcatgcctgtaatcttaatactttgggaggccaaagtgggaggatcccatgagcccaggaatttgaggttgcagtgaggtaggctgccctccagcctgggcagtagagcaagactctgactcgtaaaaatacattaatgcatttttcttctactctctactcttaactgatttaaaaagtgatcatataaaacagtgtatatataatgtcatttgggcctataacatatagaaatgtaatatgttttcgcatacagcaaaaaggacatgggtggtattaaagttgtactgggataaggaaattactccagatgataattcaaatcaacaggaactaatgaaggaagccagaaagataagataaatattaacaagagctataaacatataattactatcctttcttagcatttttggaagacataaaattatagaaggtcataatttataacaatgcattatggagtttgtgatgtttattgatatgtataacagcaataccacaaaaaggagataaagggaatagagctatataggagtaatgtttctgtggctcattagaatatagtataaattcttgcagttaagatgtacatggtaagcttagagcaaccacaaagcaaataaaaagtagtgaaaaattattaaagtaaaataccgtactaccaaatattcacttcatgca

SEQ ID NO: 46181 - DNA, 456 bp, Homo sapiens
gtagaagaagccaagccaaagaaagaacactggttaaagtaactctaggtaaaatataaaagccagtactattacatttgtggtttgtaagtcctctttttttcctatatgacttaaaagacaaatacataataattatgaatctttaaaaagataatttcaacttttattttagactcggggtacatgtgcaggtttgttacctgggtatattgtgtgatgctgaggtttggggtacaattcatcccatcacccaggttataaatctgtcaaatggcacactataaaaatgtaatttgtgactaacaataggtggggaggggcagggatgtataggtgcagaggttttgtacactattgaagtgaagttggtattaattcaaactaggttgttttaagtttaaaatgttaattattatacccaaaggaaccactaagaaaataattaaaaactaa

SEQ ID NO: 46182 - DNA, 285 bp, Homo sapiens
cattagcatggtatctttgttacaatgaataaaaatgttattgataaattgttgttaaagtctatactttatttaggttttcttcgttttcatttaatgtcctttttgcatttcgtggatcactgccaagatatcatattagatttgatcatcatgtctgtttaggctcttcttgtttgtgacagcttccagactttccttgtttttgatgctttggcagttttaagcagtcctagtcagctattttgtccaatgccctttaattttggattttatctttttctc

SEQ ID NO: 46183 - DNA, 377 bp, Homo sapiens
ttgtatttttagtagagactgggtttcaccctgttggccaggatggtctcaatctcttgaccaccaattctcctacctcatcctcccgaatagctgggactacaggtgcgtgccaccatgcccttctaatttttgtatttttagtagagttggggtttcaccatagtgggcaagatgatctcgatctcttgaccttgtgatccacctgcctcggcctcccaaagtgttgggatttcaggcatgagccacagtgcctggtcgatttaaagttttaatcaagtaaataggacatgtttattatttaaaatgtaaaatactacattaaattttatgaaaagtgagtcctctgctccaatcccagtctttttccacaaaga

SEQ ID NO: 46184 - DNA, 275 bp, Homo sapiens
tcataattttcttgtcaggattcccgtgaagattacgttgacctcaaaaactagttgggaagtgttccctgtttttgtattctctggaatagtttgtgtaaaattgccattattggctccttaaatgtttggtagaatttactggtgaagatgtgtgggaatggagttttctttgtggaaaggctttgaattagatttgggttctttaataattgtaggattattttttgagatggggtctttctatgtttcccagtctagtcttgaactcctgg

SEQ ID NO: 46185 - DNA, 1120 bp, Homo sapiens
cactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccagtgcaaaggggggccagattctgtgtgtttctctaacctctttgtaaataaatgcacagtgtaacatatgtggtggactctcactgaatgattaaatgggagaaatgctctttttcctttgga

SEQ ID NO: 46186 - DNA, 1614 bp, Homo sapiens
cactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccttctctgggcgtcactttcctcatctgtacagtaagtgtccatgtatgcaaaaggggtaattcggtttgaatttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgta

SEQ ID NO: 46187 - DNA, 1674 bp, Homo sapiens
cactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccttctctgggcgtcactttcctcatctgtacagtaagtgtccatgtatgcaaaaggggtaattcggtttgaatttccccgttttagtttagaagcctagtctgtttgttcccctccaccgctctccctctcattcctgatgagccctctcattcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacatatgtggtggactctcactgaatgattaaatgggagaaatgctctttttcctttgga

SEQ ID NO: 46188 - DNA, 1512 bp, Homo sapiens
cactgacccgcggccgcagcgtggagcagtcaccaccccgggagcgtccccgggccgccggccgccgtggacgcatggccgaggcttcgggccgccgcggctcgcccagggcccgcaaggcctcgcgctcccagtctgagaccagcctgctgggccgcgcctccgcggtcccttcggggccccctaagtaccccacggcggagcgggaagagcctcggcctccacggccacgccgcggcccagcgcccacgctggcggcccaggccgcagggtcctgccgtcgctggcgctccactgcggagatcgacgctgccgatgggcgccgcgtgcggccccgagcccctgcggcgcgtgttcccggccccggcccgtccccgtcagctccccagcgtcgtctgctttacggctgcgcgggcagcgactccgagtgctcggctgggcgcctggggcccctgggacgccgggggcctgcgggaggcgtcggcgggggttacggggagagcgaatcgagcgccagcgagggagaatcgcctgccttcagctctgcctccagcgactcagacggcagcggtggcctcgtgtggccgcagcagctggtggcggccaccgcggcctctgggggtggagcaggtgcaggggcgcccgcaggccccgccaaagtcttcgtgaaaatcaaagcttcccacgcgctcaagaaaaagatactgcgtttccgttcgggttctctcaaggtcatgactacagtgtgagtttggggatttgcttgggctcccccttcatggcctctgcacctccacactcccaaccactgacccttccacatctaccttccaaagaccatcgttttctctgcttccaaagacccccctcactctccccactcctaacagtcttggttgaaaaggctcccccaccaccaccgagaggaatggggaggagccctgtttgacccagttcagcttctagcttggaagcccttgggcaagacagttccccttctctgggcgtcactttcctcatctgtacagtaagtgtccatgtatgcaaaaggggtaattcggtttgaatttccccgttttagtttagaagcctagtctgtttgttcccctccaccgctctccctctcattcctgatgacactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgttccaatctagtattttttttcttttttaaaattactgtatttattatgacgatggtgactccccagtgcaaaggggggccagattctgtgtgtttctctaacctctttgtaaataaatgcacagtgtaacatatgtggtggactctcactgaatgattaaatgggagaaatgctctttttcctttgga

SEQ ID NO: 46189 - DNA, 327 bp, Homo sapiens
attaatttcaaaccaatcacataatccagctgcaactgtactgtgtacaacagaaatcctggacaaaactggctgtggccaagcagggaatgtatgggaacaggcagccattgtctcgctcagcatccacaataggacaaacttcctgaaagtaaccatccctacacctgcagaaaatctattaggtgggtgcaaatgtaattgcagttttttaccattactttcaatgacaaaaaccacaatcacgcttgcaccaacctaacacatcacagtccatcaaactacacattcacagcactcaaaacaataagtgccacatgacttctg

SEQ ID NO: 46190 - DNA, 792 bp, Homo sapiens
ttaggggagagagaagcttcttaatgaaaataaccttggtagctagtctcaagattagcccccagtgctccccacctgctggtatccgttgtacaacacttcccacatttttctggggtcgttttgtgtaaccaataaaatatggcagatgcgatggcatgttacttctgaaattgggttataaaaggtactgcagaccgggcacggtggcttacgcctgtaatcccagcactttgggaggccaagcctggcggatcacaaggttaggagttcaagaccagtctggccaatatggtgaaaccctgtctctattgaaaatacaaaaattagccggcatggtggcacacgcctgtagtcccagctagtcgggaggctgaggcagaagaatcgcttgggcccgggaggcggaggttgcaagtgagctgagatagcaccactgcactccagtctgggcaacggagcgacactccgtctccaaaaaaaaaagatactgcagcttctatcttggttgctcacttgctatcttgggtccctccctctggggaaagccagttgccatctcccaaggatccctatggacagacccatttggcaaggaacagccaccagctagctgcatgagcgagccatgttggaagtgggtcctccagctgcagtcaagcttccagatgaccactgccctgggaaacgactgcaacctcatgagagaccctgagccggaaccaccccacaaagtcactcttgatttcctaagtctcagaaactataaaatataaatgtgtgttgttttaa

SEQ ID NO: 46191 - DNA, 821 bp, Homo sapiens
cgggagtctctttaggttgcccaggctggtctcggactcctgggcccaagtgatcctcccacctcgacctcttaatgtgctgggattataggtgtgagccacttcacccagcacattttctttcttacgctcttattttcactttagagctcatgagaggcctctaatcgactagtatgagttttgagctaaatatgtatttagttattagtgagaaaatggacaatgggcaattgtgagtcaaataaatgctaaatttttgcctctccaagaaggcagcaggtggctgaaatcctggtgtgatatggctgaataatgcatgatctgaggaccctgtactggttactcctgtacacgttcacaatttttctgtaaatgtattaatatactgagcagtccaggagcagccattaggcaaacaccactccttgcttccttcatgtgacctatcactgagctcaccagctgaggtcaattacattcttcccaacctggagaacagaatttgggtctgctcagaggcatgatgtgaaacatgtctgggataaaagctttgttctattgacagcaaacctttttgtgttaaggggtaggggaagagcaagtgaaggatgcagattaatttctatttaggaatatacttttatatattgtttgaaattttgtcttttaaaaatattcatacaaatttaaacaaaaaattacttgtgaacagattgacaaatgtcatgtgcacacatatttattaatttgaaaaagcattcactgtgttaaatttatggtgaaataaagttgattaaactttgaaaaaaaagagtatg

SEQ ID NO: 46192 - DNA, 882 bp, Homo sapiens
  misc_feature (22)..(22): n is a, c, g, or t
catggtgtacgcccccgagtantggatatcgtcgaccaggccgtcgcggacgcgtgggcagttatacttattgggcatatttatcaatcttggccggcaataatgcctggatgcaatcactctgacacagttacacatgctttctgatctcagtatttaccataataaatctgctcatataattgaggcataccatcctcaaaaacctttttgtaaacaggattggacccagttagaaaaagatgaacgtacttgtttaggaagattgctttgcagaacagacagaggtgctgcacaatgattcctatggaatcattattaattggtaccctaaggggatgtttagcttgaattgcacctctcagtctgcgtgccatggccacactatgttcagatgatctgaacaaaacggtcagatggtagaaatgataagaagtatggcaaaagttcctattatctggaaccgtggcggtatagtggcacctcaacctcaaatgatatggcctgctctagaagcttaacataaggatttgtggaaactattagatgttcttaataagatcaaaatttgggaaagaataaaaaggcatctagaaggacactctacaaacttgtttttggatatggcaaaattaaaagaacaaatatttaaagcatcccaggcacacctgaccttaatgccaggaactggagtccttaaaggagctgcagacaaattagcagctagtaacccattagaatggataaaaacacttggaagctctgtatttcaatgatgattgtgcttttaatccatgttgtttgtctttgtatagtgtgcagatgtggatcctgactcctgtgagaagtagctcactgtgacaaagctgcctttgcttttat

SEQ ID NO: 46193 - DNA, 1034 bp, Homo sapiens
tctccatactaaacaattatttcttctggcttaccttccatttcactaactccttcttcatctttttattctgttgttaaaacacctatccggtttttaattttgtttgtaattttcatttctatgatttctagttactgctaagtcatattttatagtttcctactctctaaggaatttcaagattgtcatatttctttggtaatggggcagttattttatagtctctgataattccaaatctcaagtttttgcaggactatttctgttgttcccagtggttcttacccttatgcatggttcttattcccttctatgcctaattatcttagtgagttagttattttacgtgaaaaaattacttataatcttaagcctagggtgaaggcagcttcctccaggtgtcaagagacaacacctgcctagaatcactctaatccaagttcgagacttggttccttggcccacccagtagaagttaacccaggccacaagtaaggatgcagactattctgagtctctcaccccacaaagcttttaaaactcaaggtcaagtggtgaaatgtttgccttcaggacaagagtaattctcacttctgtcaattgagttcccataacccagcccttcaaattttctctacttttcaactttctggtgttttcacaaaagttttgttttataattttacaacagtgttggttgttttcagtaagaataactaacctcaccaactctgggaaccataccttccatatcctttattctcaagaacaatttatgaattagccagaactactttagattgcgaggttaccaattcccaattcaaacaagatcaagtacaaaagagaacttttattgcttcatttaattaattaagtctaaaggttatactggctccacatatagctagatccaaaccacaaaataagtcattagaattctctcagcttaagcagaagggtgtcctccctaaggcagacctgacagccacatgcaccttcatgcgtaccacattcctgtcctgtgatcc

SEQ ID NO: 46194 - DNA, 385 bp, Homo sapiens
atttccacttctaattttaaaaatattcattcatctatagataaaaccactggacaataggttgacacagagcctcatagcagagagctccagctgtcccaagagcccagtgccagccccagcgtccctaagagtgggcccacccaacatagggtgcttccaccctggcacaggggaagatcacagccccaacagaaggcgttcttgtcaaaatgttcagcccgagtctcatcaagcctttagtgctaacttccagaaatcggagttacagaaatgggggatagaggaacaagctgaatgaccccaaaaaagggagcaaacagaaagacccagaaagtgagaacttccacagtacaattgaccagttatcaacacatgcatggca

SEQ ID NO: 46195 - DNA, 600 bp, Homo sapiens
gagccggtccaatttggcggggctttaaatcgcttgaatccgagaggcagagcttgcagtgagccaagatcgcaccactgcactgacagtgtttcatcatgttggccaagctggtttcaaactcctgatctcaagtgagctgcccaccttgttctctcaaagtgctgagattacaggcgtgagcccctgcacccagcctgcataactttttttaaaaggcattgttgccttgttcccttgaatcactttctctgggaaactagctatcatgtcatgaggacactcaagcagctctgggagagaccccctgtggctagaagctgtggattctcaccaacagccatgcaagattccccagccccagtcgagccttcagatgaccacagccccagctgatatcttgactgcaatatcatgaaaaaccatgtgtcagaactgctcagacatgttgctcccaaattctggacctgcagaaaccatgaaagacaataaatgattattgctgttttaggtcactatgttttgagctaacttcttacacagcaatagatactaatgcatattttaaccagtttcctacattaaaacctttctgttgga

SEQ ID NO: 46196 - DNA, 993 bp, Homo sapiens
tagatgtcactttccttagtgtaaaacggttagttctggtgaggacttttttttttaaaataggggagcaggcttgatggaatgttaagtgccgctggttgacctaggttaaagtatgattacagagtgacagtgaggatttaattcaacagtttatgtgaagaaattttataacttatgtgatagagaagtatcaattattgatgtgaatcattagtagttagaagagatctataatacaaaccaggaacagtagcacacacatgtagttccagccactctgcagaggctgaggtgggaggattgcttgagcacaggagtttgagtctgcagttaagttattaccacacaactgcactctagcctgggcaacagagtgagactccatctctaaaaaataaaaattaaaaaagagatctacaatacaacaaaatttgagaatttctggtttgggaagaaaggtagaaattggattactatgtaatgaatatttcctaagggttaaacactttatatatgttctcatttaatacttttgccttctctttgctatgaggaaactgaaattctggaaaaatagtaacttgtttaaggtcacaggtagtgaatgtggaagcttctttcaaatccaggctttgactttaaaagccacgttctttctaccgaagcactctgcttcccatacacctagagatagagtgtatggcccatgaataattaagagtaagatgaaaagctaatctttcagtttctcattgagacacagtgatgccttgcatttattattcctccttttactatatttaaacatttcacaataatttatttatcttttaaaaaaataagagcactatgaatttgacaggaaaacttgtgagatatcagatggattacataactaaatattgtatatcacaagctagtttttctctacctctggtttcttaactgaaaaaaaaaagagttgtggagaacgttaatggattgtaatac

SEQ ID NO: 46197 - DNA, 419 bp, Homo sapiens
tataaggttgttacgtggtggacttagcatttttagagaccagaatatggaattttgttcttaggtaagtggtggttaggttcttttttttttttctttaaatatgagacagagtctcgctccgtcgccaggctggagtgcagtggcgcgatcttggctcagtgaaagctccgcctcccaggctcaagcgattcttctgcctcaggctcctgaatatctgggactacaggtgcatgccaccacgcccaactaatatttgtatttttagtagagatgaggtttcaccgtgttgtccaggatcgtctcaatctcttgaccccgtgatccacctgcctcggcctcccgaagtgctgggattacaggtatgagccattgtgccagggtgggttcggttttatttttgcctagttgaaatcagg

SEQ ID NO: 46198 - DNA, 429 bp, Homo sapiens
aaatatacatttagtacagccatgttgtacagttcaaggagatgctgttcacattgtgttctatatgaatggcacttccttcaggaatgaatggtgccttctggaagttggctgctagttgtataaataagctaatggcttcagtaattgctgttagaggaatatgcattatggcagtagccttcttcacttccggcgtacaaatgattgccttgacagtcactctctatttaaaactggtcagatgtatataacagcaagaccagaaaaagtttgtattttacagtagctgaggatttcaaagttcccaacaggaatgatgggagctgtgtatgaaattaaaatttgcttgaggtttcagaactaagagcatgggaaatggttcagtataattttttcatcattgctgtttatggaagtattatggaa

SEQ ID NO: 46199 - DNA, 388 bp, Homo sapiens
aaaaggtattcagtaaaaagtctccctcccactccttggaccccagccatccttttctgttcgatgactggtttcctgtaagtcgattcagagatactttagtatatacaagctaaacagttacaatctttcatgcctttttttttttgaaacggagttttgctcttgttgcccagcctggagtgcaatggcctgatcttggctcaccacaacctccgcctctcgggttcaagcgaatctcctgacagcctcccgagtatgctgaggcaggagaatggcgtgaacccaggagacggagcttgcagtgagtcgtgatcgcaccactgcactctagcctgggtgacagagcaagactctgtctcaaaaaataaataaataaataaaataa

SEQ ID NO: 46200 - DNA, 587 bp, Homo sapiens
gcggccgcccgggcccgggcccgcgtcgggcgcctggctctgtacgcgagcccggggatctgcggccttcgtgccccccctcccgggaggagcgtggagcggcggcggcggcggcggcagaaatgatggaagaattgcatagcctggacccacgacggcaggaattattggaggccaggtttactggagtaggtgttagtaagggaccacttaatagtgagtcttccaaccagagcttgtgcagcgtcggatccttgagtgataaagaagtagagactcccgagaaaaagcagaatgaccagcgaaatcggaaaagaaaagctgaaccatatgaaactagccaagggaaaggcactcctaggggacataaaattagtgattactttgagcgacgagtagaacagcccctctatggtttagatggcagtgctgcaaaggagggcaacggaggagcagtctgctctggccaaccctcatgtcagtgatgctagcaaaacctcggcttgacacagagcagctggcgcaaaggggagctggcctctgcttcacttttgtttcagtgagtacaaagcctaagttaattcata

SEQ ID NO: 46201 - DNA, 416 bp, Homo sapiens
aaatataatgtcaaagaatttgagtaagatagtcacatttttagataggttataatacaatgataatgttggtatgctctccataattatttttagagaggcctttttaaataaaccattcatcttatatttgataactgtttttaacccgttgcatgtttgggcagtatcagattatctttctcatgtcatttgtgtgtttctttactgttttccagcgacgagtagaacagcccctctatggtttagatggcagtgctgcaaaggagggcaacggaggagcagtctgctctggccaaccctcatgtcagtgatgctagcaaaacctcggcttgacacagagcagctggcgcaaaggggagctggcctctgcttcacttttgtttcagtgagtacaaagcctaagttaattcata

SEQ ID NO: 46202 - DNA, 828 bp, Homo sapiens
acaattcccacttgggggtgtctgccagacagaggggaagacagggaataagacgatgacagaacagtgtgatccaagcccagatcccactctaccaccgggtggggtatggctgtgggcaattcactaatcctgtctggcttcagtttccccacctataaaataatactactactaccctctagttcgcaaagctggagtaggattgagataacctatacgaagtactcagaacactaagtgctcaaagttagcgatgagttcctattatactggagggaatgtaggtagtgtgaatatcaggctcaaatcccagcttcaccacttgggcttgggcaagtgatgtgacctctccagattcggtcttcgtcttatctataaaatggtaatgaataaaatgcctccctcataaggttgttgtgaggatttcataaaatagtgcatgcaagaccctggccagtgcaatccatggaccttgttgtatgagggaaggatgacggaggggtgggggagggggtagaaatgcagaagttgttgtgggaacaaagaggaagggaagtttctgggagttggtggcatttgagccagatctcagaagatgaattggatacttcccagcaatggaaggtgatgagggcattctggaaaggggaacagactgcctcagaggccagctggggccggctcacagaggactctgaaagccaggccaaggagcccgagagccatgcagagctgaggagctggagcaggaagtgcctcggcttcagaagaaaggaggactgatgagatgggagggggcaaagtggaggatgggggtccagcaag

SEQ ID NO: 46203 - DNA, 382 bp, Homo sapiens
gacgtgcaaagtttaaaaaggatgcgtctggctgctgtattgagaaaactgaagaagcaggatcaactaagagactgttacaggcatccaggcaagagatgttgatagcttggaccagggtggttgcactccacacagtgaccagcactggctaagtgacctccctcaacgatggaaatgctctatgtctgtacacatggctgttaagcacctgaaacgcagccagtgcaagtaagagactgaatttttaaaatttaatttgtgctccagttttcctaagagttctcatttgggccattccttcttttctcttttatttgaaattttaattaattttaatgtaaatatagtcacatgtggctcgtacaacacagggagtgag

SEQ ID NO: 46204 - DNA, 477 bp, Homo sapiens
tggtcatctcacatattgctgctggggctgaaagaagtttgtgttgtgatgtattacatttgtcatcctgtgcccccaaagcccctcctcttcttacattgctttattgcagtacaaggtctaaaacccatgaatcttgctgtcttccaatagcccccttccataacacagtgacctgcgcagaattagagctaataattcaaaccaaaaaggataaaaagcataaagcaactggcttgcttccagattccaccatgacatttttaaagcccaaatcaaatattttaagcagtgccctttctgagtcagaattttaagcagcaccctttctgaggctgtgtgtggttctgtcaggagccctgggttctagttttgcttctgctaaatatagaaggcaagtcatgagtttcctcatctttaattggaagaggcagagactgcaagatctctaacatcaatgtcaactccaatattcta

SEQ ID NO: 46205 - DNA, 435 bp, Homo sapiens
actccatctcttctaaaaatacagaaattaagctggcatggtggtgggtgcctactaaggaggccgaggcaggagaatcacttcaacccagaggcagaggttgcagtgagccgagattgcgccatagcactccagcctgggtgacagtgtgagactctgtttcaaaaaaaaaaaaacgagggggacagtttttgtctttgctcacaaaatgtgaggagatgtgtgagaccatgaggaatagtgtcccagcacctggcaggttcagggaactgcatgttaacttcaggtggggcctttccaagaattttaccaccacgtattatagcttcagcacttactacctaaagaagatgtagtcccttacttgatgcacgaaagtcctattggctgctggattccttctttccctttttggcaaagagggcataatattct

SEQ ID NO: 46206 - DNA, 367 bp, Homo sapiens
atctcattaatagtcacatccctatggacatgaacacttaaggtacttgctgggaactcttcgaccttatagagcagtttggcataatccaagatacaccctttgaaacaaaaccagccaataggagctaattgaggcaaaaactgaactttgaggttctgcagttttcatttattagcctagcagtaaaacaattttcttgttaaatatgcaactaataatcattgttaatatttattaagtgcttattatatgattggcatggttttaaacttgaattatcttatttgattcttacaaaaaccttattaggtttaagtatcattattatactgattctagagataaagaatgtgtggcgcacagg

SEQ ID NO: 46207 - DNA, 271 bp, Homo sapiens
cccataggcacacacacatacatatgcacatgcaaatgcactcaagtcatgcacagatacatgcacactcacaggcacacatagacatgtacaattagacttgtgtgctgcacacaggcatgcatacatgcacatggtcacatatgtccacatgcacatacacattcacacacatgcgcgtgcacatgcaaatgcactccagtcatgcacagatacacacacgcacactcacacatatgttcatatacacataagtgctgcacacaggcat

SEQ ID NO: 46208 - DNA, 414 bp, Homo sapiens
ttttactatctcacctcagaatttaatgaagtattttaaatatattgtgacaaagtgtgataagtaatcttagttaagtctttaagaatgatttaacacgatattcactttctctatttaaaaaggcagatagctggacgtggtggcacacgcctgtaatcccagctacttgggaggctggggcgggaggatcacttgaacccagaaatttgagaccagcctggtcaatatagcgagaccccgtctcttaaaaaaaaaaaaattaattagctgggtgtggtggtgcatgcctgtagtcccagctaatagggaggctaaggcaggaggattgctagagcacaggagttcaaggatccagtgagctatgattgtaccactgcactccagcctgggtgacagagtgagacccccatc

SEQ ID NO: 46209 - DNA, 325 bp, Homo sapiens
ctggaggttttgccaaataactcttgagattttggtcaccttgctccatttacatggactttttgtgtaaaagatagggatgtgtttcagtgataagcttctctttttttcagagtatttatttgtgttcgttttcttttttggcttcctctagttggagactatgataacacaaattggaggtagctcaatgtcatttttggaccgataaggacatataattcaggtccttcaccttgcccaattcattctagcaagctgactttccctcaggccccataaggctgaccaagcaatagaaaagaccagactttataatacactt

SEQ ID NO: 46210 - DNA, 360 bp, Homo sapiens
gccagtgattcctgccacacctatttttctccttttcccctcttggaagccagacattaaagactaggaccttaaaaagcaattgcatacatggggaaaattagaaagttaccatgcatgtgtaaggaaaggtgtgggctcagaaaagacttgagaagacctgaagtttacaccacaggctgatatttggcacagagacagcctacaacaacagcaacaaaagctataataaaactgcaagccctgggaaagggagaggatttgatttccagagttaaccatattattagattcaaatgtctagttttcaacaaaaatatcaaaagacttacgaagaaattggcaagtatgacccattca

SEQ ID NO: 46211 - DNA, 449 bp, Homo sapiens
ctttcctgggccctgggtgtggaggccaccgaacaatgaaaggggaagcctgtaagaagaataacaatgacacggaagcctgctccagcctggtgaaatcccttctgcagtttttacaagaagcaaaacaaacaacagtctgacccctcggctcgcccccgacgccacaccccctcctcagtccgcatgttgggtcaggaagggcagtggtgtggccagatccatgaaagggattctaagaacaaagcctgtgccgtttacctgcagatcaaagtttgccgttaataacatgtgtgttggagagggcagagagaggaccgttgcccctgcattccattaaaaagggattatgggctgtctgaccagatggagtttcactctgttgcacggctagagcgcagtggcgtggtctcggctcactgcaacctccgcctcccaggttcaagtaa

SEQ ID NO: 46212 - DNA, 629 bp, Homo sapiens
  misc_feature (622)..(622): n is a, c, g, or t
  misc_feature (624)..(625): n is a, c, g, or t
  misc_feature (627)..(628): n is a, c, g, or t
aaatagtctccataatctaatctccagaatgcactaaaccaggagaagatccacctggaatggaagaatattaaggagaacaagtcctcatctctccaaagacccttcatccttcatttcacaatagtctttattggtctgctggagtttgctggaggtccactccagaccctgtttgcctgggtatcaccggcagaggctgcagagcagcaaagattgctgcctgctccttcctctggaagcttcatcccaaaggggcacccgcctgatgccagccagagctctcctgtacgagagatgccctgcccagtgaggaggaatctagagaagcagtctggccatagctttgctgcactgcgcacttctccttgctgccgccatgtgaagaagaatgtgtttgcttccccttccgccatgattgtaagtttcctgaggtctcctcaaccatgctgaactgtgagtcaattaagcctctttcaattataaattacccagtctcaggtatgtctttattagcagcatgagaacggactaatacaatccccatataacaaatctgcacatgggacccctgaatgtaaaattaaagtttaaactattaaaaaaagaaaagacattgaanannanna

SEQ ID NO: 46213 - DNA, 392 bp, Homo sapiens
  misc_feature (26)..(26): n is a, c, g, or t
ctgattaccgaatttaaatacgaccncacctatagggaatttggcccctcgaggcccaagaattcggcacgagcctggggctgctgcctttctttcagagatgccctgcccagtgaggaggaatctagagaagcagtctggccatagctttgctgcactgcggtgagttccacccagtacaaacttcctggcagcttccttaacactgggaggggaaaaccgcctactcaagcctcagtaatcttttgtattattcttaagaacaatttaaaaaactactactcatatttgtttagtgcttttccgtttatacaacattttccatccattttcttgtttggtacttacaacaatcctgtgagataagtaagatgagtattcttttctaactt

SEQ ID NO: 46214 - DNA, 758 bp, Homo sapiens
attcttggtcacaacaaagtagcaagttagaacttgattgtacacacatataattttgttaatcatcttcttttcttactgtggaaatggcctagaattaacaaattaagctttagcggttaagactttattgggctttttccagctgacatacaaatggccatcagatacatgaaaatatcactaattgtaatattacaattagttcagcatcactaattgtaaagaaaatgcaaatcaaaaaagaaaaaccccaatgagatatcatttcaccctagtttaaatggctgttgttaaaaagccaaaaaataacacatgctggtgaaaatgcagagaaaagggaattcttacatactattgatggaaatgtaaattagtacagccactatggtaaacagtatggaggttcctcaagaactaaaaatagaactaccatatgattcagaactactggattatgcatccaaaagaaaggataccagtatatctaagagatatctacactcccaagtttattgcagcattatcacaatacccaggataaagaatcaacctatatgtgtatcaatgggtgaataaataaaagaaatgtagtatatatacacaacagaatattattcagtcataaaaaaaatgaaatcctgtcatttgcaacaacatggatggaactggaggacattaatgttaagtgactaggcatggaaagacaaatgtctcatgtcctcattcatatgtggtagctaaaaaagttgatctca

SEQ ID NO: 46215 - DNA, 402 bp, Homo sapiens
tcactgtaaccttgaactcctggactcaagcaatcctgccacctcagcgtctcaagtaactgggactacaagcctgtgccaccacacctggataactttttaatttttgtaaagatggggtctcactatgttgcccaggttggtcttaaactcctgatctcaagcagtcctccttccttggcatcccaaattgctgagattacaggcatgagccaccacacttggttttcacagggaggtttaaagcagccacagggtgccccctctgcccaggccagaggtcagggtggacagagcacagtcagccaggatgctctcctcccacctcctcatctttgattcgagttccctccgtgaatgacgagcgtgtatgacttagataatcaagacaggccgggcgcg

SEQ ID NO: 46216 - DNA, 253 bp, Homo sapiens
cagctctcccagaagttcactgagtcaagagtgaggagctgggtctgggtatgaccatgtgtgtgctggtgggagggggcaccatggctgttcctgattctgagaggaggcacgacctatgcaaaggggagcacccaggtgtgtccctggacagggaagcctgaccccctccacacctgcttggctgggctcctgcgaaccgaagctccctcctgggtcagccctgcacgtgggttttcttgaggcagggcgt

SEQ ID NO: 46217 - DNA, 178 bp, Homo sapiens
ggatggaaatagatataacaccttgatgagtctagaaaagtttgcctcggaaaacaaagggctctaactgcctcttaaacacagttatcaatgtggtcccagtctttttttgatgtccacactgggggaaaagatagctaatagctaagcatctctgctcaggttaggggaagggcgt

SEQ ID NO: 46218 - DNA, 278 bp, Homo sapiens
gtatccgtgaagcccccttctcatagatgaatgcaggcttgccagtctgctaatgttaatgttcttgatgtttctgcaaagctcagctatcattcattacattttgattctcttaattagatttttcacattataattttaacctcagtttcctgagtactttgctgtcaactctgtcctacttctaaggaagaagtctattgcctagataataggataagtaaccccaaaggtagttacttgttgaaatacaccaaagacagtgggagtgcttgtcg

SEQ ID NO: 46219 - DNA, 867 bp, Homo sapiens
cttagaggcctaaatgtgtaagagctaaagttacaaataaactcctaggagaaaatctttgtgattttgagttaggcaaaagatttcttacactaaaagcatgattcacagaagaaaaaaaattataaattggatttaattgtaattaaaatttgccctctttaaaggatattattaagaaaatgaaaagaccagacataaatggagagaaaatagttacaagtcatatacctgaaagaggatttgtaccaggaatatataaacaactcattaagacaaacagctggtaaaaaagagcataagacttgacatttgactgaagaataaatatgcatttatgcacatgaaaagatgctcaacatctttttaccattaggaaagtgcaaattaaaatcacaatgagataccactatatacccactagaatggctgtaatcaaaaagtattggtgaaaatgtgtagaagctggaaggaaccctcatacattgctgatagacatgtaaaatggtatagctactagctttgcaaaagcattttggcagtttcctacaaagttaaacatactcttagcctataacctagcaattttattcctgagtatctacctaagagaaatgaaaacatgttcacccatagatttgtgcacagttcatatctgtattattcataatagccaaaaaaatgaaaactatttaaacgtccattaacattttgtaaatgaatacacaactgtgttgtatccatgtgagaatactactgagcataaaaaggaataaactactgataatgcagccatgtagatgaacttcaaaaataccatgctcaatgaaagaagccagacccaaaagaccacatattatgttgttt

SEQ ID NO: 46220 - DNA, 371 bp, Homo sapiens
tggactccaattattgatttaggccctaatttgtatattgacatcttccttaatactcttatttattctaacaggtgactttccagatatattgtatcaataatacataagatgagccctaaggaaattcagtttaggactgtgtaccatagaactagttaaacttgggtcatcctaccctaggcccacagcctgccacttacttaagtggtgctttgaatatctaaaacctctttcaataaatcttgagtctcctgatatttttaacttgttagaatgtaagcttcatgagaacaagattcatctttgtttgattcatttataaatggtatttttgtattaaaaaattaataaaaacttctgagtttata

SEQ ID NO: 46221 - DNA, 417 bp, Homo sapiens
tcttgctctgtcacccaggctggagggcagtggcatgatcttggctcactgcaacctctgcctcccaggttccagcgattctcctgcctcagcctcctgagtagctgggactacaggcacatgccaccacgcctggctaatttttgtattgttagtagagatggggtttcaccatgttgtccaggctggtctcgaactcccgacctcaagtgatctgcccaccttggcctcccaaagtgctgggattataggcatgagccactatgcccggccaccaatttattatttcttcccttagactgggagcttcatgagggcagaggctggctgtcatgctcaggggtgcagagaagatcctgacttaaaattcctgtgacttggacatgcaggagaagccagacgtgaaggatataaatt

SEQ ID NO: 46222 - DNA, 916 bp, Homo sapiens
tctaacactgaaagtaacttagtctgttttataatagtcatctaggaacttaatggctaaagaagaccccaggttgggcacttctaatgaatttgtagactgaaaattgagaattctgtataatgaatcagattcatacatcagagttaatactaacaagaatttgaacataataattttcctggaatagtaagtagtttgtctttatatcactaataaataatgatcagatttccatgaaacttgaattacagttaaaaaatcaataagataaaaacgtagaggataatatttgaggctgcttctctatcacaaatcaatgcaaacgccagaacactgctataaagtcaagtgttctattctgaagggtttactttgcctgtattgcaccacaatcaagttatactttttgtatttttctgaactggtctgggttcagtttcctcgaagaaaataccacctagctagtttatgtaagaaaggacagcaaattattaaaatgattgcagaattgttgagagcacttgaataatgatcctcaaactttagcattaatcagtatcagtttggaggcccttgaaaacagattgttggccccaccctcaagatttttttactataggggtgcaccaccaacacccggccaatttttgtaattttaggagagattgggtttcgctattttggccaggctggtcttgaacttttgacctcaggtgattagcatgcctcacccttccaaagtgctgggattgcaggcgtgagcctccgcatgccactgcgcccggcctatttccagtataatcttgtcattagtgctccccatcatgtatttattcatgtatccattcattcattcaacaggtattgaatacacactatgcatgcaagccactttcaaatattggcaataaag

SEQ ID NO: 46223 - DNA, 198 bp, Homo sapiens
aaaaccatccagataggaaaagcaggttacttataaaagagttaagttcaggttgatcagcaattagaagtgaaaagggacattcactgaaaggatacaggaaataggggcaagaaaatcttcagcttcatgaactgaaattgaacctggaaagttctctctctctccctgtctctctcatacacttacgtgcacaca

SEQ ID NO: 46224 - DNA, 351 bp, Homo sapiens
cttactaatatcttagtgtagttcatacacaatggaatccattctcaacaccgatttttcacaatcatttgttcacttacaagcatattttcaagtcattaaaaatggtttttgtagatatctggatggtttccaattattctctaatataaatattaattcaatgaacacacttatacagaaatcactgtccatatttctgacaattttttttggtctgaccaatgtacatccctgccagcagggactgacagtatctgtctcatcctaagctcgcaaacactgagaatgtgctatacataattagctgctacccaaatataatacagtttctgtttactcaataaagag

SEQ ID NO: 46225 - DNA, 429 bp, Homo sapiens
  misc_feature (308)..(308): n is a, c, g, or t
  misc_feature (313)..(313): n is a, c, g, or t
  misc_feature (377)..(377): n is a, c, g, or t
  misc_feature (399)..(399): n is a, c, g, or t
  misc_feature (420)..(420): n is a, c, g, or t
aattctgtttattcctccagaagaccctaaatacagacattataacaaatttgttttaatatcatactcatgtttattctccttctgcttgcttttcacaaactgataatactaacagtgtagatttaggaaagttcagcagcttttgtctcaatttgccaaaaaaaaaagaaaaaagcatttaaaagtaaatggactttttttttttgagacagggtctcactctgtccccaagctggagtgcagtggcacaatctccagactgggcaacgagagcgaaactccatttcaaagaaaaaaaaagaganaaagnataaaaggaaaaaaaatgcaaaacccactcatgggctccgggggcattacaaaaggcaggttgnctgactggctttgggctgtggntgtaagttgggcagaccccgntctaggagc

SEQ ID NO: 46226 - DNA, 900 bp, Homo sapiens
tgtacagatttggagcaataactagagaggaactatttcaagtgacttaaaagacaattgttagaagcagggtttcttaacctcagcatgactgacattttgagccagataattatttgtggggagtgggggtggggacagggcagttgtcctgtgcatcatgcgacgttagcagcatccaaggctcagcgagcttctataattggcaacaactggcacatactgccatacatcattgctgggaggattaagtgctgtctgtgcgacaccactgggggagtgttttaaaatataggttttaggtggcccgacgtggtggctcatgcctgtaatcccagcactatggaaggccaaggtgggaagatcatttgagctcaagcattcgagactagcctgggcaacacagcaagacacccgtctccaaaaaagtaagataaaaaaatataaaatataggttttattattattcaagtatggtgagggcaatagatcaggtgactgccattgacaagaaagcttgttgtacttacagattccaaaaggggcatggcacgccacagggagccacactggaagcccagggtcagtgaggaggtagagggaacgatgggatcaagtggagtaagagccttgtgatctccatgggaaggaaggggcaaggccgagtaaacagactggcgagttcgaataatttcagcaggctgtggggcctaggggctgtccctagctttctggtacctggccctgcggtgattagggcaggtggatatcccagagtatgggatattggctcagagtatgagacgtcctgtaaaggagagattggggtatgggctccagattggttggtttacatatgaaaggagcagtcataggtgagtcatttactctctccaggaa

SEQ ID NO: 46227 - DNA, 555 bp, Homo sapiens
  misc_feature (550)..(550): n is a, c, g, or t
  misc_feature (552)..(555): n is a, c, g, or t
cctcgtgccgcggcacgaggggacaacttgagaaagtcaggcaaagtaagttgccattgacagatggtgttcagctgatagaaagaatgaatggagaaggtgacagagaaagatgccgaagatcggtatagctttccatttggtatagcagaagatgtatcaaatcaaagccatttatatacatttacgtaaaaatcccacttctaggaatttagttaaaggaattataaaggtgattttaaaaacttgcagcgcaaagctattggttgctgcattcaatctagagtagagaaaaattagaataacccaaatgatcaacaattttaaaaattgagtaaattattataacatccactcaaagaaatgttatgcacccattaaaagttatcattatgagaactatagaaacaaggaatatgttatatttttaagtgaaagtcataaaatgtatacatgtggacatattatacaaaaatgtatattttgcagataaaactctgggagtgcctgctcttaacaaaataaagttctttattgcatttgtcaaaanannnn

SEQ ID NO: 46228 - DNA, 488 bp, Homo sapiens
gaccagcctggtggactgaatgaacaggaggttcacgagttcagagaaacaagagagagagagagagagaacccagtcccaacacgggtgcacacagcatggctgggctgcgtgcacatctgacggctgtgaagatgacactgggcttggggttgcagttgggtatttagatctcaaactgtttcaaaaactgccagttgcatgagttatgcagtgacttagatttctgcaagcttcaggctcctaatctgtaaaatccaattaatgataactgcacaaggctaaaagaattaagaaataatatatagcatgtagcttatcgtaaatgtgcaaatgttagttttttgctttctgaaggcagtagaaatgaaaaagcagagatgagacagctggtaaggtaaatatagtgagatttgctaacaaatttgatattaagggcagggtgaggagcagggaggaggaaaggagagagatatcaaacactgctt

SEQ ID NO: 46229 - DNA, 167 bp, Homo sapiens
ggtgccattaacaaaaataaataaggaaggagaatgagctagggagaggcatatgaagcttttgagtttctggtcaaagccaggcagaaatgcccagcaggcaattggaaatgaaggtatggagtttaggagagaggtcaaagtttataatactgatttggagacct

SEQ ID NO: 46230 - DNA, 400 bp, Homo sapiens
attcttaaggcgagtgtagagggaaagggatgggaggtgggcgccgtaccatcccctctgcccacagcgtcaggacgctgtgcaacttccggaggcttcctgactgtgggggttggggggactcctttttcacaatctgccaagtggggacacacgatggctgcccctggcgtggccagatggggtcctgatgtggggggtgtgcagtgagctctgggcttggtctgttttcacggggagagctctgtcgttgagggctgaaccagggacttttcatctcctcccctccagctcctcccctgctccgcagccctggccctgcgagtgctccgtctccccgagctctgactgtcccttggttcgtggcaccagggctggccattacaccccacgctctctt

SEQ ID NO: 46231 - DNA, 929 bp, Homo sapiens
tatcatttttctgggcagttgtgttacagctgaaaatcaagagttctattactaaagaagggtagaatggatattaggggtcagttagcaggctgtgccctaatacttatttaaaatgtgaatgtaaatgtaaatgagcctaaatcttggtgtctctcttatgagaaaacctgattacttgcaagagtctttttaaaataacatttaaaccaattaagccaagcacggtggctcattcctgtgatcccagcactctaagaggctgaggtgggagattcgcttgagcccaggagttcaagaccagcctgggcaatatagtgagataggtctccacaaaaaaaaaaaaaaaaaatagccagtctgggtgccacacacctgtagtcccagctactcaggagactaaggtgggaggattgcttgagcccaggagcggaggtcgtggtgagccactgcactccggccttagagatgcagcaagatcccatcaaataattgatagattgatacctagctagctagctagatagatgatagcaaattttgagggaagatcagaatattttacaattgaccataaagaagtttaggtacattacaatgcaaaaacacaaaaaaacccaggctgtcgaagttgaatagtttttttcttcaaggtcattgctctacattcatattatgatgtctggaaagacatgttaattttcagaacatagaattactggtgaggaagttgaaaaacattccttttttccctcctatagcacatatggtatcatttctaaaacatatttggatgtgtgcacttcatggcctggactagggtgaggcaagagaaatttataagacacaaaatttaaggaggcacattgtcttaggttggaacaagtgtgagctctgcatctgcaccaccctaaaagtgaatggctcct

SEQ ID NO: 46232 - DNA, 978 bp, Homo sapiens
gactaatttttttcacataactttaggattttcgaaagttgtaaccataactggatatcttagctgagcaaaggcggttataatttgtctttttaagatcactggaaattgataaaattttgtgataattatgattattctgtgccatttacagtttctaatactatactgtatgaaatatgtataaatatatgatgctgagtctgtggaatgatacttctgaaatcaaaattcctcataaggcatgaagttgtaaaaacttgaatgtgtatagttagatatttaaatggttgcttcttcatagaattgtctgctttttaaaactggaagtacaggattttcttcaggtaaaatctgtgtgttccaattacagttgtagctgaaggaagtatgctttggtgagtcaattagtatgggaacttgactaaagacccccagtgttgtaacgtacctttgtacccagacaaaacaattatgttacattcctcaaagtggcatgggctttcttctctaattcttttgttttattagacccaagacaagttctaaaaattgaatgcaatgagagattgtccagaaatgtaatatatactaaaatataccacttaagcattgattgccttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacacgtactataaaagtcagtctatgtacatactgcttattgatgtgctgtgatatgagggaatctgaaatgtttcataaaaataaagcttaaaaattgtcttacactggaaaaa

SEQ ID NO: 46233 - DNA, 1241 bp, Homo sapiens
gccttctcgagactgcaagagaatttgagatcgattttgcaggcactgacagcggctgctactctgcctttgtggtctgggcaagatcagccatgggcatgttcgtggatgcttttagcaagcaggtgtttgatagtaaggagagcctctctacagcagctgagtgtgtaaaagtggctaaggagcattgccagcaactgggtgatatcggactggatctcaccttcatcatccatgcccttctggtgaaagacatccaaggggccttgcacagttacaaagaaatcatcattgaagccactaaacatcgcaactctgaagagatgtggaggaggatgaacttgatgacgccagaagccctgggtaagctcaaagaagagatgaaaagttgtggggtaagtaactttgagcagtacacaggggatgactgctgggtgaacctaagttacacagtggttgctttcaccaaacagaccatgggcttcttggaagaggccctgaagctgtatttcccagagctgcacatggtacttttggagagcctggtggaaatcattttggttgctgttcagcatgtggattatagtcttcgatgtgagcaggatccagagaagaaagcttttatcagacagaatgcatcctttttatatgaaacagtcctccctgtggtggagaaaaggtttgaagaaggtgtggggaaacctgccaagcaactccaagatctgaggaatgcatctagacttattcgtgtgaatcctgaaagtacaacatcagtggtctaatgcttgggtctgtttatatgtgtatatatgcagagagctttatattatttatatttatattaagttgtattagcatactctatagtttcaaacacaacttgcttttcttgtttgcttcaagaatataaaacttgttacttgagcttggaatcatgggcttgattgaattaattactcttggggaaaaaagacaccttgtggcattaagtcttgctttggttaaagccttatttcacataattgctaaaaactcatttttgtttaatatactacctatagtttaattatcggcacttgtattttgtaacttgatatcttacctaggattgggaatttgggacatgacacgtactataaaagtcagtctatgtacatactgcttattgatgtgctgtgatatgagggaatctgaaatgtttcataaaaataaagcttaaaaattgtcttacactggaaaaa

SEQ ID NO: 46234 - DNA, 922 bp, Homo sapiens
gccttctcgagactgcaagagaatttgagatcgattttgcaggcactgacagcggctgctactctgcctttgtggtctgggcaagatcagccatgggcatgttcgtggatgcttttagcaagcaggtgtttgatagtaaggagagcctctctacagcagctgagtgtgtaaaagtggctaaggagcattgccagcaactgggtgatatcggactggatctcaccttcatcatccatgcccttctggtgaaagacatccaaggggccttgcacagttacaaagaaatcatcattgaagccactaaacatcgcaactctgaagagatgtggaggaggatgaacttgatgacgccagaagccctgggtaagctcaaagaagagatgaaaagttgtggggtaagtaactttgagcagtacacaggggatgactgctgggtgaacctaagttacacagtggttgctttcaccaaacagaccatgggcttcttggaagaggccctgaagctgtatttcccagagctgcacatggtacttttggagagcctggtggaaatcattttggttgctgttcagcatgtggattatagtcttcgatgtgagcaggatccagagaagaaagcttttatcagacagaatgcatcctttttatatgaaacagtcctccctgtggtggagaaaaggtttgaagaaggtgtggggaaacctgccaagcaactccaagatctgaggaatgcatctagacttattcgtgtgaatcctgaaagtacaacatcagtggtctaatgcttgggtctgtttatatgtgtatatatgcagagagctttatattatttatatttatattaagttgtattagcatactctatagtttcaaacacaacttgaaaattaaaagtgccctcttaaaaatacaaaaatcaaaa

SEQ ID NO: 46235 - DNA, 427 bp, Homo sapiens
gacatcttgaagggagcagttcagttacagcattctctccatacccaactataccatctctctactctttatcttgccctcacatacacataagtttgtcattgttcttcagttctttgggtaatctcttcctagaaactgcatctaacaaatagaccacatccccaaattccatcatgtccaaaaagaagcacggtatttccatcaacaccccagctgccatcaccaagccaactcgcctgacttccattcacttactagcaaacatttaccaagtatctgccatgttcattttgtcaatgagaatgacatgggacttgttcctctaggagatcacagtctaatgagatcaatgtttatatagaaaatgtaaataggttgtgataagtactaaatgcacgctgctaatggcatcatcacctctggc

SEQ ID NO: 46236 - DNA, 398 bp, Homo sapiens
taaattccttctgcttatcctagtcataccttttccccacccctgatccctggccacaacaggtatttttactgtcgttatagtcttgtctttccagaacgtcaaataaattgcatcatatactatgtagtcttttcggactggcttcttttacttagaattaagcatttaagatttattcatgtttttgtgtgcctagataagtaaatattttggttgatgaatagtgttctgttgttgttggaccacagtttgtttattcatctgtctcttgaagaacatctttgttgtttccagttttggccaattattaaataagctgccacacccattcatatgcaggttttttttgtgggcataaatttgcaaattagttcaatgtatacctaggagtgtca

SEQ ID NO: 46237 - DNA, 850 bp, Homo sapiens
ggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggactataactacattctaaatgagaaataaggtcaaaatctatatacattctttataaatggatgtccaaagtaatcctagggaggagagcttttttttttttcatttccattttcatttaaaaatggatacttgattattggaaaacttacaattgtgtttggaacaacttgggtatttgaatctaattttccaattgcaaattttatgatacctaaatacagataaagtatttccaatgaaaatttagtgtccaaatgagtggggctataaatgtaaaatacactggattttaaagacatggtagaaaaagaacagaaaatattttttgtattgattacatgttgaaacaatattttggctataatgggttaaatatactattaaagttgattttatctgtttctgtttacttttatttacgtggcttacattgcatttctgttggacagtcctgtatttaagtatctagatggcaacattttacatacacaagcatcaaactctgtggtcagatactgttttttctgatctaggaaagagatctgggaaatacttcactcaaaaagaacgagtagtgccttccacaggttaggagagtgtaaatgagtctggtagtttgtctatttttattgtctttattactatagtaaatattctataaatatttgttaaaggag

SEQ ID NO: 46238 - DNA, 324 bp, Homo sapiens
caaaatatgtttaactatccaaaataaccaaaccaattatgcaacctgtttttcaaccatatttatagataaaagagcttatgtcatttcagcagacagatattaatgtaatctgtttcacagtgctcaactgttataccacaaaaattgaggcttcaccacaaaatgagagaaaacaaatgttaaacttgcatcatgatggagtagctgagccaatatggggatatacagcaaataaatgataactgaattatttgtttttattatagtgaatcccagtctgatctccaaaataaaatatgatttaaatcagcaactagtaat

SEQ ID NO: 46239 - DNA, 559 bp, Homo sapiens
gtcttcatagcattacaaatagaagatggttacttttctttcaaaagacccttggtcagagaggcagatggcacagtggataggcttctgaagtggagaagttagcataatttatgggttttatggatttatcctcctcctaacatttctgtttctccgttttgacttttgtcatagttcaaagaaggacatatttgttccctactggctgtgttacatcatatggaatttaaagtcactggaattgaggtagcagtgagaagcatcatatgatttaaaataaagctttgggtcaatatttactgaagtattacatcaatatatttcctgtttggctgacaagagttaatagctgattttaaacttgtttatctttgctcctagacaaaagttttgttcgaggagattctaaattacgtatttctttcttgatactgctatggaggtgaagcacatagcaagccactttatcttatattttgtattggtaaaaaattttataaattctatgtaagaatacaaaaaaattaaaagaccactgttttttgtcaaacacttg

SEQ ID NO: 46240 - DNA, 866 bp, Homo sapiens
gtccttcagggatgtctggggacctgtccttatccagactggatttcatttttgtttttgaagccaccatcccagaacagtgaagacagtacagaaagctactagaagcaaccagatgcaatcctgtactctttctcaagcaaggagggactgcttatctgttggcatctttatgcactgtgtggagtactgatgaaaagtgacagcatttcatagctgtgtttaggggaggtggggagccgactgcagtgctatccagacagctcaccctctttgcagctattaagagtctcatcaaggctgtctatgcgatgtcgtcattctcacattcccagaagtagaatttgaaaagatcagtgaacattaacaatttcttcttctccctgacatatgcacacatacagcctgcttttgtttacagttgtaatttttaaaataaaaaatctttggtcctgaaatattaaactttcatagtcttgctcactggggcagaatgaaggaaacaaactgagaggctgggtgaggtttgtgttttcagcagcatcatatgaggtgaggaatgtctgcttagatctggggcttgactgggtctccgcattctacactgccaccacagacaagtttggaggtgttcctggggctcagacacttgaaaacgtggggacattctcaaatttctcatcactataagtccattgaagggtttttaaaaaatctttctttctctcttttcctccctccttccttcccttcttctttttacatttagctaattcctctgaaaaaaaaaaacagtgaataattggaagtcagtagaactgggatcatgtttgccttgaagatggaacttggggctatcccctgca

SEQ ID NO: 46241 - DNA, 346 bp, Homo sapiens
tttttgaagagcaattaggcaaaatttagctttctacaaacagtggttaagaactgtttttccttatactcttgtttactgtatcatcagactttttaaattaataaaataacatttattttattaatgttataataaatgttattttaattttaaaaaagatttattagatacttaatatttctttttctaaggattattttaagtagcatttcccatcatgcatttatagagtagtgctaatttataaacattaggtttgtacatgtcttaaaggaatacatttgttttatgtgtcatacctataattctaggcagaaaccaatactccttggagtacagagta

SEQ ID NO: 46242 - DNA, 396 bp, Homo sapiens
aactttgggtcaggtaagtctttgttgtaggggctgacctgggcattgcaggatgtttagcagcatcgctggcctccactcaactagatgccaggagtgcacgtccacacacacacatatgcaacttatgactataaaaaatgtctctagacatcgccaaatgtcccctgggagatgaaaatcaacccctcttgagaaccactgctttagagaagggggtgaagtattctgttccaaaacatacatataagaccttaagtgttttcaagtatttagggaaaaatggtgttttagaaaaaaatatagtgacattctggactatttctgtgtttatttgtggccgagtgtaacaaccatataataaatcacctcttccgctgttttagctgaagaatt

SEQ ID NO: 46243 - DNA, 417 bp, Homo sapiens
tatttttagtagagatggggttttaccatgttgactgggctggtctcaaactcctaacctcaagtgatctgcccgcttccgcctcccaaagtcctgggattacaggcatgagtcactgcgccgggcctatattttatctctctgtcttccatatcatcttctgttattgttttcatctctatgccacttctttgtattctgacactttctcagatttgtcctttatgttaatgatttagtttctttaacttttttcccctgaaagtaatgtatgttcattgaaggcaaatttagaaaaaagaaaataaaaatcacctattaatccaatactgtttatgctttgtaggtactttttaagacttttttcaacaaaatgtgttttgtataatatttcgttttataaccggcaaaaaaaaa

SEQ ID NO: 46244 - DNA, 606 bp, Homo sapiens
tatttccaattcagagggcttttgctgtatgggctttaactgacttagctgaataggaattaccatggggtattttggcagtgccatcattggtcacctgtttagcttctgagatgctagcaaattactcttagtttgttgtccaaaatattttgtgggaagaaggttagaaaatagaaataagtatactactgactctatctcatacatggaagttttgaggacaaaccacactccagttggtcatttaccctagattgtggcattgataccgtcttctatctctgagaagtaacccatagtaagcagtataaagaggagggtgactggtggggcgtgatggctcacatctgtaatcccagcactttgggaggtggaggcaggcggatcacttgaggtcagagttcgagaccagcccagccaacatggcgaaatcccatctcttaaaaatacagaatattagctgggcatggtggtgcattctactaggcagactgaagcaggagtgttgcttgaacttgggagatggaggttgaagtgagccactgcactccaggctgggcgaccgagtaagactccgtctcaaaaacaaacaaacaaaaccaa

SEQ ID NO: 46245 - DNA, 1167 bp, Homo sapiens
attacaggtgtgagccaccgcacccagcccaaagtcatttgcccaaagtcatttttttagtagtagacagttctaatttacattagtaatctcttcatatacttagtatttattttttctgtcaagagcaatgagagttaattagaggagataataataaagttgttcacgtggctgtctgctttgaaagggaatttcagaatttgactggagtttggatctccctcctacctagtattaactttgccataagcatcaccagcaggtggcagcagttcccatgttctaaaaatatcgtcactagttaagacaggtatagagtatgttgttttgttacagaagtagatttaatttctggtatttaaattttcctcattatatttcattatagtctgttttatactttagtagacagaatggtatctaacagtactatcaaggcaggaacagcagtattatcagaaatttttaaatactcaaaagtgtatgtgaaccacagttgacatcttatgcaattgttacatagtagagtgtcactcctgatagtggcacttaaccttcaaccaccaaagtagggaaattaagttgtatataaagcccctaagtaggaccaaggaattgtaaccccatggtgccctctgatgctggtaagagtagccagcctgctccccaaaccttagcttaactaaaaaaatcaggccagactgagtgtggtcagaaatctggttatgggagctttaggggtattcttagccaatgtttatggtaataatcaactttcatcacccatcgtttagactgtacagtttctcaggttgtctgaagatttaccactccaaggactcccacatttctctgagccagaggatgctttggagaagattgtgtacattggaaacttagggagatttgatgctgaagttgctaagtacaaagttaacacagtcacttcttttccttgcttggatctcctttttttcccttcattataaaaacaaaccaaaaaaggaaaagcagctaaactcacactaatacaacataaatacatgtaaattttaaaagcgattgtcttaccctcagtaccattctactttttgcaacctatagtatttcctagaataactcacttatttaacaaatactgatggaatacccagcaatgggcct

SEQ ID NO: 46246 - DNA, 1234 bp, Homo sapiens
gagtgccagctatcacacccacattccatttggcagggatggggaagcaagggcagaaggctatgctccaaccttcaaagacagacacaacacttccacttacctttcgttggcctgaacttagtcacatggccacatccagctgcaagggaggctgggaaatgtctttacaccaggtgcccataagtgcagctagaaaagacaccggggcagacaatagtctcccctacagatagggaagactgagcccagccaggtaagaacttcttccagattcctgagcctggcatctggagctgctgtgtcccacactgtagggactgaagacgtcatggctgagcgcctactgtaaaccacgtgctgctgagggctgaggtggctcaggccctcaagatgctcctggggaagggagagggggcagctgagctgggaatagagctagtggtcaccccaggaagctggggacagcgtcaacacattggttaccagtgcaggtcttgaagttatacagatcctgcttgcagccccagctccagcactccctaggtgtgtgaccttgggcaagtgactgtacactctctgcctcagtttcccctttcctgaagtgcttggcacctaacactttctcaagaagtactcagggcgcttgttactagcagggaggactatttgagaattccacatagggccgtgggactcagtactctcccaggaggactccttggaggaggtggccttaatcctgagccttgaaggacacagcaggatgtgggcaggcagagtggtgctaagcttcatgagggttaaccaggtagcggttgtaacccggagcaaaagcagggagtcctagcagggaacaacaagggtcctcttaggcatttgctcctgacttagtgttgatcagaatatgacgctgtgccgaggcaggaggatcacttgagcccaggagttcaagaccagcctggggtcgggcatggtggctcatgcctgtaatcccagcactttggaaggccgaggggggtggatcacctaaggtcaggaattcgaggccagcctggtcaacatagtgaaaccccatctctactaaaaatacaaaaattagccgggtgtggtggtgggcacctgtagtcccagctactcggtaggctgaggctggagaattgcttgaacccgggaggcagagattgcagtgagctgagatcgcaccactgcactccagcctgggcaacagagc

SEQ ID NO: 46247 - DNA, 672 bp, Homo sapiens
acaacagcagaattcttgtgtgaattcaataatgcttgtgaagtgcttggcacctaacactttctcaagaagtactcagggcgcttgttactagcagggaggactatttgagaattccacatagggccgtgggactcagtactctcccaggaggactccttggaggaggtggccttaatcctgagccttgaaggacacagcaggatgtgggcaggcagagtggtgctaagcttcatgagggttaaccaggtagcggttgtaacccggagcaaaagcagggagtcctagcagggaacaacaagggtcctcttaggcatttgctcctgacttagtgttgatcagaatatgacgctgtgccgaggcaggaggatcacttgagcccaggagttcaagaccagcctggggtcgggcatggtggctcatgcctgtaatcccagcactttggaaggccgaggggggtggatcacctaaggtcaggaattcgaggccagcctggtcaacatagtgaaaccccatctctactaaaaatacaaaaattagccgggtgtggtggtgggcacctgtagtcccagctactcggtaggctgaggctggagaattgcttgaacccgggaggcagagattgcagtgagctgagatcgcaccactgcactccagcctgggcaacagagc

SEQ ID NO: 46248 - DNA, 302 bp, Homo sapiens
ggacaacgaagcgcgtccggtgatttcaaggtggggctaggagtcttgtgagaggaaactcggtcctgaccctatgtgagtgctgaaattcatagaactgtgtagacaaaggtcaattttattgcatgctaatttaaaaacatttaaaaataaaataagctttaaatgcctttaagacataatttaaaataactttagaaaaattccagtgagagactcatcccataatttagccactccttctgatgctagactgctgcactgttcctatctctgtataaataaacctgtattggaaactc

SEQ ID NO: 46249 - DNA, 521 bp, Homo sapiens
cacattattgacaccatagagatacaccttagactactttgtcctcttctacagctagcctggcatattctttttaggtactcaaaaaataaacttaacgagataccagtgagaaccttctagatgctgaattgtccagtataacggataaggtcttattaactttcgtgacagaaaaatccaggtatttataaaaatatgagccctgttttggttttgacaacctttttacattttaagactatgttaacatattaacattttaatttacctgtcactgaggggaatggattcatgttaacttctcataaagaggcgtacagcctgtgcagcatggcgaaaccctgactccataaaaaaatacaaaaattagctgggcatggtggctaatgcctatagtcccagctacttggggggctgaagtgggagaatcaacctgagccagggaacgtcaagtctgcagtgagctatgattgcaccactgcactccagcctgagtggtagagtgagagcctgtcttt

SEQ ID NO: 46250 - DNA, 708 bp, Homo sapiens
cttatcttaatagcctattcatccaagcagtctcgattagaacaacaacaaaaaaaaccctttctgattatttatactgttatataaaatgtatattaacttctagcaatcactgaagaaagctggagagttttctaaaatgttgttattttttattggatcagcttttttgttttttaccagatagtttgttttttatatatgaaaatgtaaagctgaaatctcttgtgaaataactagtaaaattatacctgaatatgtttttggctctgctcatgtcgaatcacaggggattttttttcctaaattagctcatatagataattctttccataaggatattgttagaacttcagtttctactggaaataacctaacttcagataattttcttcttcctgttcttaaaaaaggaaaaaaatgccaagcaaatatgattactgacattattacattctagagtgctttaaattgtcctaacagattggtagcctaattttttcacctttctccatatgcacgttttcaatcctggttaaaaattgttatatgtacccaagaagccagttgtatggtatttggaataaatattaatatttacttgttgcctttataattaatacagcttttgaaggatatttctcttgtatgaaattcccccttctctaacatcatatgtccagacagggcagagtttcatctgcgagt

SEQ ID NO: 46251 - DNA, 566 bp, Homo sapiens
cttgaactgctcctgagtctccagccaatcagcctcccagaaattgccacagtcacctcaaccttcagcaaccaccaacttgatcaatcagcagccaataacgtgaatggtgaccatggcaataaactgactactattaggccattaatggcagtaatctggccttgcaagccaccaccctaacttgatgttgtcaaactgtgatgacatagcatttcataaccttggactattcaaactagtactatcattgaaatgatggagaaggtggccgaaaacaaattgaaatgatagaggagtgataacctttgttataagctaaaatttgaatatataaattaacaatagatgaaagtttaaaagggttttgtgcctcttaatagaaaaagaaatattgggttaatttttgcctatttgaaatagattcattttgttttgtcttaaattcactgaagtagaaaattagcatgaggttatgaaaataaagaaaaaactcattgtgaactaaaatgaaaagtaattaattggcacactttcagctgcttctaagagagagaatgcattgc

SEQ ID NO: 46252 - DNA, 303 bp, Homo sapiens
aaaagacccaactatacattgtttacaagaaactcactttaaatgcaaagacatatagatttgaagtaggaaatggaaaaagatatacaaggttaacaataattaaaataaagctgaaacagctatattagttttcagacagagtagacttcagagagaaaagataattctggatgaatataggcactgcttgataacgaaaagtgaatcttctgagaaaatataacaattcttaatgtgtgtgcacctaacaagagtgttaaaatacgtgaggcaaaaaactgatagaactgcaaggataaa

SEQ ID NO: 46253 - DNA, 975 bp, Homo sapiens
gtttccagcagatacctcttggatgttggacttgaattgctataattttgatgaaatgatgctcacaatagaatgcagtgaatcctgctgttaatgcacagttgccttctaaaaaccagaatgctcggcaaaattgtacaataaagaggccttaggatatatggggaaaactgggttagaggctcagcaacccaaaacttcaacagtgacatacccaagaataaagataagaatctaataagagcagcacagtttgacacatgttaaatggttaataaatatggcactttaccttggaaaagacctgaagtgtgcctgtagaagtgggcataggaagggttgcagctcatgaattaaggtgaagctgtggaaggagagtcagctggaatcagagggtgagttctaatcccaggactgggtaagtgtgactcagtacttgcagtgaacggaggctgctcactcgtgttctgtgtgttccgatgctggggtgtggttttccacatttcacctagcgttgctcctggatgagaccatgcgtaagcaaaattgtgaaatttgcgttctgctcatattccttgtagttctgctccatattccattatttaatttcctggaacaagtttgtgttttccaaacaaatgtgatatcaatattgactttaaaagacactttgtggtggagaatgagtggctatttaccatttatttctacccagaaaaatactctttgtacttctaaatgaataagaattgtggacaacctctaaggtacaaaactctttcttcccccttaccagatcagaaatgatccccactgaacatgtaaacacatttagattcaaataattattttatgtgttttgcttaaaatgcttaaaatctgtgggaaattaaatgccctgtaaacccggtaagaaaacacaaaacacataaagcctgtgagaaattatatgccctacaatcctgcctctcccaa

SEQ ID NO: 46254 - DNA, 311 bp, Homo sapiens
gagaaactaaaagatcaaatgtataattaattaaattatagaatgatggaacaatggcattcagagccaatccgaaggttcccagactccacactgaggcaccccagagtgccgagctggagtcatgggaagctgccggagacttcagctgcagaagactttaagtttccagggaaagagctgcacaaaacatctggtcaggaaccacgcaagctttgagtttgagagctcatagtttcaacatcagatcacactacattcttttcataatttcatatttttgtgaagctggattttcagccattgctgtg

SEQ ID NO: 46255 - DNA, 139 bp, Homo sapiens
gcggccgcctactactactactgctcgaattcaagcttctaacgatgtacggggacatggaaaagttgcctttatggaaacttggcagagccagagtgtacacattcctaaaccattaaacagatttctataacaaaaa

SEQ ID NO: 46256 - DNA, 2183 bp, Homo sapiens
ccctgccctctgcactaagcactttccaggcaggcctggccatagggcaagagcaggccttacagcagtgccacggtgacccaagaggcagggttggggcctggacagggcttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctggcacctgcattgaggggagtctgggtgcatcagattggggggcaccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgcccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagtgaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggagcaggtggggtcaggggccagagtgcaggggagggggcaatggtggaggtggcggggggaagcagagggaggtgggctgaggcctcggtggggccagtgcgacctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatacaaatctttataccaaatctattttttaaaacatggaaaagttgcctttatggaaacttggcagagccagagtgtacacattcctaaaccattaaacagatttctataacaaaaa

SEQ ID NO: 46257 - DNA, 1874 bp, Homo sapiens
ccctgccctctgcactaagcactttccaggcaggcctggccatagggcaagagcaggccttacagcagtgccacggtgacccaagaggcagggttggggcctggacagggcttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctggcacctgcattgaggggagtctgggtgcatcagattggggggcaccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgcccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatacaaatctttataccaaatctattttttaaaacatggaaaagttgcctttatggaaacttggcagagccagagtgtacacattcctaaaccattaaacagatttctataacaaaaa

SEQ ID NO: 46258 - DNA, 1647 bp, Homo sapiens
accccagaaacttcagccccagcagaaaggttgtgaggctggaggaaggcactgcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgcccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagtgaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggagcaggtggggtcaggggccagagtgcaggggagggggcaatggtggaggtggcggggggaagcagagggaggtgggctgaggcctcggtggggccagtgcgacctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatacaaatctttataccaaatctattttttaaaacatggaaaagttgcctttatggaaacttggcagagccagagtgtacacattcctaaaccattaaacagatttctataacaaaaa

SEQ ID NO: 46259 - DNA, 1319 bp, Homo sapiens
tgcatagattcgatgttacagagtcccagatcataattataatatgccagcttctcacaggaaccctggggccttggttctggaacttcacggtaactgctagaatattcatgctatctgatgtacaatggtgtgaattcaataaagacagcacctttgtcatgcacagaataattaaaacatgaaaaatcaaaagtcttcctgttggtatgtcacaaacaggttattagaaaacataattttaatatattagggcaataaaaatccaccctattaaataaaatttttaaaaagtggtatttctggtgatttgatgctaaagtcaattctcctgtttgcctattgtgcctattatttttattctatgtactattttttaaaacaaatacctttccaccagtaaatagaattttttttatatttctattttgaaaacagaataaagcaagcagagtttttcttaggtaaggaagttgagatgattctatattaatgtaggaaagattctgcttattctgttaacttctttagcatatactttaagcagtctagtactagttctgcttgagtttacagcagtcttggtgttgtataatatttatgctggaagctattctcatttctgtttgttttgcttaatgtttttcactcttagttgtgcttttgaaactaaatatccttagcttttcatgttactatagtcattctttgaatactttccttttttgttttgttttcttttcagtaaatacatatttctctaatgtactgctaaaagtaatgtatctttttccttttttttttttttaattgagatagagtctcattttgtcacccaggcaggaatgcagtggcacagtcatagctcactgcagccttgaaactcctgaactgaagtgctcctctcacctcacctttctgcactgtcacacctggctaattttaaaatttttttttgtagagacaggtcttgctgtgttgcctaggatggtcttgaacttctggcctcaagtagtcctcccgcctcagccttccaaagcactggaactacaggcatgagccactgcattcacccttctttcttataactgcagttttgaccttatgacttttaaaaacattgttaggaaatgttttcccagtaagatagtccagaatcattcacactttagcataagaaaaaatagggcttagattcagtttatttggcagttcagagaatgttggagaactgttcaaatgaaaacctgacagatcattatatcaatgcaagggtttattaagtttcctacattaggtcgcctgccctgaaaaaaaaa

SEQ ID NO: 46260 - DNA, 388 bp, Homo sapiens
caaacacttttttttttttaacagcccagaggtctttttttttttttaaatacctattatgccgtgaattcatagagaataggttccagcagctcaggctccttcccattggttctcacaaagtgtgctttgctgggtggagcaggctggcgctttagttgaacccaggtacctttctctttggcttctctctttttctgatcattctccttcacgcgtttcaggaagctatctcggctctcagagtgcttaatgtgctcaatacgcacattaattctcttggcaagaatcttgcccttaacttgtttgtttacaacaatgctagcagcatactggataacattgtagactcttccagttttgccatggtaacacttgtggggcgttc

SEQ ID NO: 46261 - DNA, 769 bp, Homo sapiens
gctgaacaggttcgacaactgtggttgccatcaagtccccagcacaccttgatcagtgcataaagcctctgatcctccttagagaaggagggacttgggtttctgccctagtcctgttcatcttgacgggggtaagatcttgccaaaacacaaggagacagatgactgcaatgcaagttgtggggtacctccattgctgagaaactcctgctagaccgcagccaaggggttttatgttctgcgactcttttctgagggagaataaggcagaaagtccatatctcagaacctgagaggtgatgagaagctgtcttgggacacctctgaggaagatggggaggccagtgaagagtgggaggggcctcccattcttcggtgttccaggaggatcacagggcaatcagtcttcaaggctcagggaaggctgagtccaagcctttgtttatatggaaggtcttaacggtgctatggcaaagtaacgcagcctggtagaagaaataaagataagacactccaagtcagccagtgttattttgtgtggtggctcacaaaaaaataaaaataaataaacaaataaataaaaacacatgaccatgagacaagcactttcttttcctataaaaattacctttaaaaaaatcacataaatatgagttacgattacatgctaattttgtggctatataccacatttaatagaaaatgccatttagaattgaaataacttgcagaagtagtgtatgcatattttagagaaatgagaaaatat

SEQ ID NO: 46262 - DNA, 334 bp, Homo sapiens
tatttatccaatgcctatacccctattatatcataaaagtaactaacttggccaggcttggtggctcacacctgtattcccaactctttgggaggccgaggccggtggatcatctgagatcaggagttcaagaacagcctggccaatatggtgaaaccgcatctctactaaaaatacgaaaagattagccaggcatggtggcacgtgcctgtaattctagctactcaggaggctgaggcaggagaattgctggaacccggaaggtggagattgcagtgagctgagattgtgccactgcactccagcccgggtgacagagaaagactccatctca

SEQ ID NO: 46263 - DNA, 327 bp, Homo sapiens
aagaaagagcaacatgagcagccgatgcaagtggtccggaacgccagctgctgagcctcaggatacaagcagctgagcagcaagcagagaagcaagcaactgagcatcagagactacaaatagctaacttcagatggtgcggcttcagggaaagatcaccttcttcctgcaccatcccctttccagctccacatgctgctgagagccagtcttcaaacagtctgtgtgatctgattcttcctgcacactgaaaaagaacttgggtgtcaaaaaggcaggtgcaggaggctgtcaccctgacccttcactgagctgttaacacttagc

SEQ ID NO: 46264 - DNA, 379 bp, Homo sapiens
tagcagaacagacagacccagagcagcgaagttgtttgttcaagatcgcactgtttgtcattggcaaagctgagaactcattgatttatttattcattggacacgtatatttattgaatccctaatgtgtgccagatgctttccaaggcacgtgtgacacaacactgtttgaaacaatgtgacgataccattagtgtaacaacggaacagaattaacaataactaccattttttataatgcaatgagtatttttttttttgagacgaaatttcgctcttatggcccaggctggagtgcaatggcacaatctcggctcactgcaaactccgcctccccagttcaagcaattctcctgcctcaggctcccgagtagctggg

SEQ ID NO: 46265 - DNA, 4886 bp, Homo sapiens
tcgttgatatcaaagacagttgaaggaaatgaattttgaaacttcacggtgtgccaccctacagtactgccctgacccttacatccagcgtttcgtagaaacccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaataaagtgtgtgtctatctgtgtctgtttgcctatttgtccat

SEQ ID NO: 46266 - DNA, 2816 bp, Homo sapiens
tcgttgatatcaaagacagttgaaggaaatgaattttgaaacttcacggtgtgccaccctacagtactgccctgacccttacatccagcgtttcgtagaaacccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttaaaagaaa

SEQ ID NO: 46267 - DNA, 611 bp, Homo sapiens
cgatcctcaagctatccggttcaatacactgctgttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgggtaagagcagcgggcacgcacatacctgaccccccaagtccaaggatgggcttcaccacgtcccagggatttctcccccttcccagtttagcgattccatgttcatggtggaaaatttgtctttgaatatttaatactgaaccagagagagagaaagtgccagttagtgggaaaagtcccaatttaggaaccaaacgtctgcgttctagccagctcctgg

SEQ ID NO: 46268 - DNA, 276 bp, Homo sapiens
agagatatatgaaaagaagggagaattaatattgtattgaggccggccgcatcacgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaataaagtgtgtgtctatctgtgtctgtttgcctatttgtccat

SEQ ID NO: 46269 - DNA, 4626 bp, Homo sapiens
cgatcctcaagctatccggttcaatacactgctgttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46270 - DNA, 4603 bp, Homo sapiens
tcgttgatatcaaagacagttgaaggaaatgaattttgaaacttcacggtgtgccaccctacagtactgccctgacccttacatccagcgtttcgtagaaacccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46271 - DNA, 4606 bp, Homo sapiens
cgatcctcaagctatccggttcaatacactgctgttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46272 - DNA, 1973 bp, Homo sapiens
acctagaggatccccacgcgcacgcgcacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46273 - DNA, 2004 bp, Homo sapiens
tagctgatcttgagtatcctcgacgctgcgactgatcgcagtcaacgaacgtccgtacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46274 - DNA, 1134 bp, Homo sapiens
tgaaccgtggtatagcagctgtcggccgaatccgggattattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46275 - DNA, 869 bp, Homo sapiens
agggaacagtccctgggaattaactgttacctgaaaactattcgtgactgttaacagagcaatgcagtcctctgatattcagaacgtcttatgttagtagctctaaaggtggctactatactgcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46276 - DNA, 281 bp, Homo sapiens
cgccatggctaagctggtagtacgttggcgatggcccatatgggaagtggaagtggtagatcttcaggggactttcaaaatgctttgaatttaactctttcttcccctttattctaattcctagtgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgccgtaagtagatgtagtggcca

SEQ ID NO: 46277 - DNA, 647 bp, Homo sapiens
cagtccagggattctcaaaatgtgacttccacaccagtagcataaacatcatctattcacagacacacaccagcaagatacgggctttccctgcaacattacttaagccaaaggctatttcccagcatactgaatttcttttatgtattcttccctaccatccttccacctccttattgctaggatcacaatcaatgtaaaaacaattgtccccagttaaatggacgcttagggctagagcctctaatcttacatgtgttgctggtactactgtctttttaatatgtatattaaatctgattaacattaatatttaattattaagtatatttaatatgcattagtgctttagaagtgttcccaggatgaaacttgcatttttcctccaccagcgtttcgtcagaacacacatggtatccagatgacatccatcaagaaacgaagatccccagatgatgaactgttatacttaccagtaggtcttccttgggtgttcatggttgcttcattttaaccttctttgaatgggcttttacagtatgatcatcatctcattatctgtgacaatgggaaaggaggtgtcttagtcagttgaagctgctacaacaaactaccgtagactagatggcttataaacaacagaagtt

SEQ ID NO: 46278 - DNA, 4757 bp, Homo sapiens
gagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46279 - DNA, 2082 bp, Homo sapiens
  misc_feature (1542)..(1542): n is a, c, g, or t
  misc_feature (1771)..(1771): n is a, c, g, or t
  misc_feature (2075)..(2075): n is a, c, g, or t
agatgctacagcgactgcacacccaggctgtatgatacagcctattgctcccgggctgcaaacctgtccagcatgtgatgtggtgggatactgaattgaataccgaatactgtaggcaattgtaacacagtggtaagtctttgtgtatctaaacatagctaaacaccaaaaggtatagtaagaatatggtattataatcttatggaactatcattgtatatgtggtttgtcaaccagaatgtagttatacagcacaggactgtgcttatgatgtgccaagcacagctctcagtactaactcctttaatcttcatatcaaccctaggaggtaacttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagtgagtgtatcaacgtgtcattttaggaggcatgagtganggtgactttatttggatcagcaatagggtgattgatgagcaatgtggaacataatgggagatagcagattgtcatagattcagatgacctggtatggcaaccctctttcagttgcaaccttttttacgtgtcttattataaccttcccttcagaattccacttatgttctgaaattaaatacaaaccatttctggtgaattacaaagaaactcacactaacagttctcntctctatatgcctggtccatacacactaacagtaagtacacactctatttggtagtgatgtgtatatttgaaaacatgaaatcttttctcatcccaatggattgtcttataaatctcctgggatgcacactatccacttttgggaataacactgtagaccagggatagcaaataggctttactataatataaagtgacttgtttgaatgctgtaatgagaagaattctgagacctagtgcatgataattggggaaatatctgggtgcagaaggataaggtagcatcatgttgccgtattttagnatctctg

SEQ ID NO: 46280 - DNA, 432 bp, Homo sapiens
  misc_feature (392)..(392): n is a, c, g, or t
  misc_feature (400)..(400): n is a, c, g, or t
cgatcctcaagctatccggttcaatacactgctgttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgancgtattcnattgaaccggatagcttccgagatcctgtaga

SEQ ID NO: 46281 - DNA, 4713 bp, Homo sapiens
agatgctacagcgactgcacacccaggctgtatgatacagcctattgctcccgggctgcaaacctgtccagcatgtgatgtggtgggatactgaattgaataccgaatactgtaggcaattgtaacacagtggtaagtctttgtgtatctaaacatagctaaacaccaaaaggtatagtaagaatatggtattataatcttatggaactatcattgtatatgtggtttgtcaaccagaatgtagttatacagcacaggactgtgcttatgatgtgccaagcacagctctcagtactaactcctttaatcttcatatcaaccctaggaggtaacttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaaga

SEQ ID NO: 46282 - DNA, 2600 bp, Homo sapiens
cgatcctcaagctatccggttcaatacactgctgttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttaaaagaaa

SEQ ID NO: 46283 - DNA, 451 bp, Homo sapiens
ttagtagagacagggtttcaccatcttggccaggctagtctcaaactcatgacctcaagtgatctgcacgcctcggcctctcaaagtgctgggattacaggcatgagccaccatgcctggccaatttcactatttttgaatgctgttacaaaacacctaataagctatctaaaaaaaaatcaaacaatatttgaaatataaggttataaagctaaatgtaatactatccaataagtctctcatacatcatttataaaaatatatcttatacatttcctttaattgtcagataaattataagagccttgtttttcgataccaaacactgaatttagaaacttaacagaggaggatggccaatcatctggtgacatataatgaaacctcagttaaccagaatatagtgtgttggaaatccttggttaactagaattttgctaaaaaaaaaaaa

SEQ ID NO: 46284 - DNA, 227 bp, Homo sapiens
agtagagatggggtttcaccatgttggccatgctggtcttgaactcctgacctcagatgatccacccaccttggtcttccaatgtgtagggattacaggcgtgaggcactgcacccagtcatttttttatttcataatagtatgtcatgttatgccttagtgttggtaggaataacaaaatgaccacttgttgaactccttcaatgtgccaggcacttcgtatctct

SEQ ID NO: 46285 - DNA, 1300 bp, Homo sapiens
gggaccggcagacaggcgtcctacacccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacacaaaaaaaaaaaaaaaaaaacaaaaaaaaaaaacacgtggtgtgcgcgcgcgcgcgccccgcggcccccctgagaaaacccctttcctataaaccacactcgggtggggcgcgcgccgggccacccagttaggtaaagggaacaacggtggccaagcgagggggcatccccaagagggaacaccggggcgacgagtgcacaagagggcgcgcgggaattctcctaccacacattaaacaaaccgcgcgcgggggggagaacccccgagaccggtcctgtgagaaccaatactcccgaaagctgggagcagcctcagaagggccaactacagggggagatcatcctcaccagggagcgcgccccagggaggctcgacatatccaaatttaacagcccccgagtcaggggga

SEQ ID NO: 46286 - DNA, 496 bp, Homo sapiens
agcggccgctcgcgatctagaatctcttgctctgggccctgcaggagggcgtgggcagcgtgggggctgtggggggatgagctcactctggccccacagacctgtggctccaaggaatcttcccacggccactcctagggctgccagacatacgctggagccaggagcgttatcaacgcaaggactggtgatgagtagagacggggtttcaccgtgttaaccaggatggtctcgatctcctgacctcgtcatccgcccgccttggcctcccaaagtgctgcgattacaggcctgagccaccgcgcccagccctatggcaatgactcttaaaagttcgaggctcaggcaggccgggagccccaggtcaaacatgcccatccccagccccaaatgcccagaagcaaaaagcccgccgtgccatgtttcatcaaggcaccacatcctccgtggccagatcgtcctccccttcctcctcacaccctgccagctggccccc

SEQ ID NO: 46287 - DNA, 1666 bp, Homo sapiens
gggaccggcagacaggcgtcctacacccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacacacgtcggcgctgtccgtcttctgttttggggcctccaaggcctcactccactccggaacctgggcccccactgggctggactgggctgggctaggcatgggcggcctctgggaggacccttccttagtcccctctcccaccactcaggctcctgcttcccagagagtggccaggaacacacgggcagatgaaaaggggtgcagagacagacgggggatctggctggtggggaccgggtggaccttggcccccatcctcagcacctgcccccaggcgacaggttcttgccacccacccttgctctcttgctctgggccctgcaggagggcgtgggcagcgtgggggctgtggggggatgagctcactctggccccacagacctgtggctccaaggaatcttcccacggccactcctagggctgccagacatacgctggagccaggagcgttatcaacgcaaggactggtgatgagtagagacggggtttcaccgtgttaaccaggatggtctcgatctcctgacctcgtcatccgcccgccttggcctcccaaagtgctgcgattacaggcctgagccaccgcgcccagccctatggcaatgactcttaaaagttcgaggctcaggcaggccgggagccccaggtcaaacatgcccatccccagccccaaatgcccagaagcaaaaagcccgccgtgccatgtttcatcaaggcaccacatcctccgtggccagatcgtcctccccttcctcctcacaccctgccagctggccccc

SEQ ID NO: 46288 - DNA, 892 bp, Homo sapiens
gggaccggcagacaggcgtcctacacccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacaca

SEQ ID NO: 46289 - DNA, 748 bp, Homo sapiens
  misc_feature (23)..(23): n is a, c, g, or t
cggctggtacggccgggatgtanggatcggaactgggcccccactgggctggactgggctgggctaggcatgggcggcctctgggaggacccttccttagtcccctctcccaccactcaggctcctgcttcccagagagtggccaggaacacacgggcagatgaaaaggggtgcagagacagacgggggatctggctggtggggaccgggtggaccttggcccccatcctcagcacctgcccccaggcgacaggttcttgccacccacccttgctctcttgctctgggccctgcaggagggcgtgggcagcgtgggggctgtggggggatgagctcactctggccccacagacctgtggctccaaggaatcttcccacggccactcctagggctgccagacatacgctggagccaggagcgttatcaacgcaaggactggtgatgagtagagacggggtttcaccgtgttaaccaggatggtctcgatctcctgacctcgtcatccgcccgccttggcctcccaaagtgctgcgattacaggcctgagccaccgcgcccagccctatggcaatgactcttaaaagttcgaggctcaggcaggccgggagccccaggtcaaacatgcccatccccagccccaaatgcccagaagcaaaaagcccgccgtgccatgtttcatcaaggcaccacatcctccgtggccagatcgtcctccccttcctcctcacaccctgccagctggccccc

SEQ ID NO: 46290 - DNA, 488 bp, Homo sapiens
tgagtccccacagacagtaattcctctgatggatctgaacaaaataagttgaaaactgctggaaagaattcatcattctacataccattaagaacattcgtgattcatgggaagagcttaaaatatcaacattaataggagtttggtagaagttaattccaaccctcatggctgactttgagaggttcaagacttcagcggaggaaataactgaagatgtggtgaaaatcgcaagagaactacaattagaagtggagcctgaagacgtgactgaattgcgacaaattcatgatcaaacttgaacagatgaggagttgcttctcatgaatcagcagagaaagtggtttttttgaggtggagtgtcttcctggtgatgatgacatgagcattgtgaaaatgaccacaaaggatacagaatattacaaaaacttaggtgataaagcagcagcagtatcgggaggattaactccaattttgaaagcagttca

SEQ ID NO: 46291 - DNA, 494 bp, Homo sapiens
catcagcagaaatttggaagcaattaatttggaggaggaaagagtctaagtaagatgcctaacagatcttggtgcgttgacaaccttgaaacttgatgttaatggacaggtacaaagatgaagatgagctgaacagtcttagtggttgaagctgctgcatgtaagataagcatgttaaatccatgccatgtatactgcaaatcccaatcctgtgcacaaagcaggcattgctaagaagaccctgctgtatttaaaaagcctagatgcactgatagaaccctcaacacaggactccagccatggactaccattggttcagagctgccagtccagtagtagcttatgcatcacctacggtagagtggaaactctcctgcacacgccagtcactccaagggcactttaattaaaaccacacaaaatttttgtagataacaataaacttgattatggataaatcatgaaatcaataaatatagagttcctggtactca

SEQ ID NO: 46292 - DNA, 438 bp, Homo sapiens
  misc_feature (304)..(304): n is a, c, g, or t
cgaccttttggtcccgggcagcccctctgcctcccaaagcactgaggctggatagcaccaggcacccagctagcaggacaactcgaggtgaggcccctgttttccccgccccgctcgccgactcgagaagatggctgatccttggcaggaatgcatggattatgcagtaaccctagcaagacaagctggagaggtggttcatgatgctcttaaaaatgaagtgaatgttatcctgaaaggttctccagttgatttggtaactgctactgaccaaaaagttgaaaaaatgcttatctcttccatnaaaggaaaagtatccatctcatagttttcactggtgagggaatctgggcagctgggggaaaaaggtgtctttaactggacaaccctacgtggatcattgaccctattgatggaacaactaagtttgtccatagg

SEQ ID NO: 46293 - DNA, 269 bp, Homo sapiens
tgacaactactgtatttagtttctccatctctagaatggacagagaagtttacctctgatggttactattaagactaagtgaaataatatgtataaagcaactattaagactaagtgaaatactattaagactaagtgaaataatatgtataaagcaacttatacaaagtttgggcaacttatacaaagttgtgtgtatcatgagccctgtgtattagtccattttcatgctgctgttaaagacatactgagactgggcaatttataaa

SEQ ID NO: 46294 - DNA, 347 bp, Homo sapiens
gggagtgctaggtattgaatgtgtcccccaaaagttcatgtgttagaaatgtaatccttctgcccctatgatgagatgaatggatgaatgagggctctgttctcatgacgggatgaatgttgctgtcccaggagtgggtttattatcacagcagcgttattcttgtgcctgtgagctctccctggctcccttgctcccactctgagcatgtgatgccctctgccatgaggtgaggcagcaagaaggccctcacagatgccggcactgtggacttccagcctctagaactatgagctaaataaactttttaatataaattacctagtttgtcatcttttgttaccaat

SEQ ID NO: 46295 - DNA, 424 bp, Homo sapiens
ttcttttttgagtctcactctgtcaacaggctggagtacagtggcacaatctcggctcactgcaacctccccgtcccgggttcaagagattctcctgcctcagcctccccagtagctgggattacaggcacccaccaccacacccggctaatttttgtatttttttagtagagacagggtttcaccatgttggccaggatggtctcgatctcctgacctcgtgatccgcccacctcggcttcccaaagtgcagggattacagacatgagtcactgcacccggcctgctgctatttaattgcaaaatgaaaagcttgcccctagagagagaatttcttgaaaatgttctgttaatgccagagctgctctggtcagagtcacatctctaacagtgggcttttattttatgctagtaaatcagtaag

SEQ ID NO: 46296 - DNA, 449 bp, Homo sapiens
aaatccttaagtctgagaaccaatgagcaagggcagctaacagtcactcttggagggaaaaaaaccaaaactagttaaataataatctagctagagagcttaaaaaaaatgtccctaggattacagtagaccagcaatttttgaacactatttccaatgcataattcatcataaaaatgtagactaggctgtaatcctagaaagaagaatactattccatcaaagccaacaatacttcaaggcttcaaaaaacttaaagcgatattaccatgctaatgttacctatttgtactgtaactctttgtaagtctagattcaaaaggagatgcttaaaagtggataaggctgctcaaatttaacaccgttatcttgataaaccttccccactactatcctccttcctctttattcaaaacattatccttgaaacaagtaattttaaggatctt

SEQ ID NO: 46297 - DNA, 351 bp, Homo sapiens
gatgacctacttacatacgacttgataagacacggcaacaggattttgttgaacgtattagaaaaccatgttaggaacaataattattgagttttaaattattttttgaactacatatgatttttttaaatgctcttagtagcaaccttcccaaggtgaaagaaaaatgaattcttagttctgagtctgtatgaaaggcattaattgccaaatccatcatatgtctctcagagaaataattatccaaaaatagaaggtttgagtgatcaaggttgaacgtgattgataagtacccataaatcaatatgctgcattaacatgcccagaaactttcaatttagaaatgccagg

SEQ ID NO: 46298 - DNA, 328 bp, Homo sapiens
taaaatgaaaatgcaggctgggtgtggttgtaatcccagccggggaggggctgcagacagcagggggagaggactgcttcttatttttttctttctccttagtctttccctccctttaaaggcttctaaatattaaattgaaatacatgagaatgtgatacagagctgtgatggcagggaaagttcaatatgtattcactaatgaaggtttcctggtacacaaggtacattgaggaaatccatgtttttccatctcacgtaatgttatgtgtatgtgactttgtggtattgtgtttggggttcactgacttttttttttaaccagtgt

SEQ ID NO: 46299 - DNA, 381 bp, Homo sapiens
tgcctataggatggtggccccataggattatagtaccgtatttttactatgccatttctgtgtttagagatgttttgatacacagataccattgtgttatggttgcctacagtattcagtacagcaacgtgctgtatagatttgtagcctaggaacaataggctatacaatatggcccaggtatgtagtagggtttcccatctaggtttgtgtaaggacactctgatgttcgcacaatgatgaaactgcctaaagattcacaacttatgtctgttgttaagccacacttgactgtgtttgatacttaagttaggagataatgctctggataatattggtgttagcatgccctttattttatgaaattatactatgttaata

SEQ ID NO: 46300 - DNA, 366 bp, Homo sapiens
tgtagtggctgttggcaagtgtgatcatgctggccatagcctcaaattcctggcctccagtgatacactagtagctgggaccacaggggtatgccatcaagcctggcttggtctctctcttttttttttttaattgatggggtctgactatgttgcccaggctagatttgaactcctgggctcaagccatcctcctgcttcagctttctgagtagctaggaccacgaggacacatcaccatccctcactaattttcagattttttggtagagattgggggtgtctcactgttttgtccaggcaggtcttgaactcatggcctcaagtgatcctctcaccctggcctcctgaattgttggaattaca

SEQ ID NO: 46301 - DNA, 894 bp, Homo sapiens
gatgactcgaatcgacggtttctcatgaggtatggagcttctctgcctcctgttcgcaccctccatgtccatgtttaacaacctaatgccagccaggtgcagtggctcatggctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgccgttaattacacttttggatcacagctggttaaattgatagatttcagtttatctcagtgaatttttagaatggagattatagcattttttaattggagaacagacatttcctaaagtatatgaaaaaaaattattcactgttggtttaaaccagtatctttgtatgagtgccaaagatatatgaacacagatactgcctgtgcagacctaaattttagttttgtgtacctggatccatatacaaattttttgtggtttatagcataaaagcagaacgttgtttctttcttagttttcaaccggctcatcttttgtttttgttttttgtttttttgttttttgttttttttgagatggagtcttgctttgttgcc

SEQ ID NO: 46302 - DNA, 641 bp, Homo sapiens
tttgctctgtttcattttgttttagagacggggtttcaccatgttgtccaggctggtctcaaactcctgacctcaagtgatctgcccgccttggcctcccaaagttctgggattataggcgtgacgtaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaattatgactggaaggaattactatttagctaagctgacaaggtcgcttcttaagatgacatttggtttcagtaatctgaccactccctcctcccagctgcggggtgaggtggcctgtagggaggggc

SEQ ID NO: 46303 - DNA, 1889 bp, Homo sapiens
tttgctctgtttcattttgttttagagacggggtttcaccatgttgtccaggctggtctcaaactcctgacctcaagtgatctgcccgccttggcctcccaaagttctgggattataggcgtgacgtaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaattatgactggaaggaattactatttagctaagctgacaaggtcgcttcttaagatgacatttggtttcagtaatctgactattctgttttcactttcatcttctttctaaatgaaaacaaaagtgctccctcccttcctggaaacctcagtaacactatgggaaaagtagaacatgacattgcagcctattgatttcttcttccagataggtttaaagtactccttaagttctgactaaatagaactaagccttattaaaaataactgcctcttgttcatgttatctgtaccttcagggacctgcctttcttcaagtatttcctagagtatctattatgatactgaagaagctaattatttgtgttgtaaatgggtataaatgaaaaaaaaacatactggtttctctagccaggaaaaatgctttctggtgtaatatatcttgctccagaaccctcattctaattgtaacactaggatcaaagaaacaaagtcactttgtggaccacagctaaactgtggatattttcccaaagacataagatttttatggcccgagcctctagaaaggaagccatgtttaggagcaaccagctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgccgttaattacacttttggatcacagctggttaaattgatagatttcagtttatctcagtgaatttttagaatggagattatagcattttttaattggagaacagacatttcctaaagtatatgaaaaaaaattattcactgttggtttaaaccagtatctttgtatgagtgccaaagatatatgaacacagatactgcctgtgcagacctaaattttagttttgtgtacctggatccatatacaaattttttgtggtttatagcataaaagcagaacgttgtttctttcttagttttcaaccggctcatcttttgtttttgttttttgtttttttgttttttgttttttttgagatggagtcttgctttgttgcc

SEQ ID NO: 46304 - DNA, 1639 bp, Homo sapiens
tttgctctgtttcattttgttttagagacggggtttcaccatgttgtccaggctggtctcaaactcctgacctcaagtgatctgcccgccttggcctcccaaagttctgggattataggcgtgacgtaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaattatgactggaaggaattactatttagctaagctgacaaggtcgcttcttaagatgacatttggtttcagtaatctgactattctgttttcactttcatcttctttctaaatgaaaacaaaagtgctccctcccttcctggaaacctcagtaacactatgggaaaagtagaacatgacattgcagcctattgatttcttcttccagataggtttaaagtactccttaagttctgactaaatagaactaagccttattaaaaataactgcctcttgttcatgttatctgtaccttcagggacctgcctttcttcaagtatttcctagagtatctattatgatactgaagaagctaattatttgtgttgtaaatgggtataaatgaaaaaaaaacatactggtttctctagccaggaaaaatgctttctggtgtaatatatcttgctccagaaccctcattctaattgtaacactaggatcaaagaaacaaagtcactttgtggaccacagctaaactgtggatattttcccaaagacataagatttttatggcccgagcctctagaaaggaagccatgtttaggagcaaccagctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgacgccaacacctcccatgtatcactactctgggcccccattcattcaagaggagacccatggggaacaaggcaaggttgtttgatttgctgagcataaaggaagaaatgaatactttcactaagca

SEQ ID NO: 46305 - DNA, 123 bp, Homo sapiens
ctgccatttaacatcccaaatatatcagaggcatcagggaaaggaactgcaactgtcaattaagtgctgtttgtaggacagggcacttgggcagtatgagcctcccccatctgaatcaaatgc

SEQ ID NO: 46306 - DNA, 411 bp, Homo sapiens
gactacaggtgcctgcccagctgatttctgtatttttagtagacacggggttttgccatgttagccaggctgctctcgaattcctgacctcaagtgatccgcccgcctcagcctcccaaagcgctgggattacaggcgtgagccaccacgcccggcctgctattttccattcctgaactccactagaataacatctcttttagtcaagtcccagtattctgagcaacactattctgggactgtaaacaagtgaggccgccaagccacacgatgggtcttcttaaagaagcagtcttgttgggcacggtggctcacgcctgtacccaagaggtggagattgcagtgagctgagatcgcgccactgccctccagcctggcaacagagcaagactccatctcaaaaataaataa

SEQ ID NO: 46307 - DNA, 403 bp, Homo sapiens
aggagcatgaaagttgatgtggtggtggtgaaaaaattgtaggaatgacaatggttcgtggacctctagagagccacaatagataaacagttatacggcagatccgaagcatttgcatttcatggtggggtggtggcaggagattattagaaaaacaaaagtctaaaaagactccctaggaagtaataatgaaaaaaagttgaaaaacactaccctaaccctatgaaattgctgctatggcttttggtagtccaacttccttccaaaatgcaaatctagttgaatgctcttgcaggtattggtagagaaaaatagcatctttaaattatgttacagccaagtgtggtggttcactcctataatcccagcagccttgtcctaattaaaatttaagttgttttca

SEQ ID NO: 46308 - DNA, 378 bp, Homo sapiens
cctccaggttctctctccatttctgcctgtgactgctgacaccctgttcaccttctccacgttgcccttctagcctctctgtgcgtgaggtcctctagttcttacagaatgtcttgtcagtgctttcaccgtgacctgccccccaccccgagagctgtccaggtgtcagtcaccctaggatgaaatgacaccaatattggtgacaagctggccttctggttatgctcaggagaatcattaaccatctttaaataaataaatccctgctgctactccccatacaatttagaacatgtgccttgtaacttttgatgtggggctcttgtttgaagccattgttgttttccctgctgcctgcatcatcatatgttatgtgat

SEQ ID NO: 46309 - DNA, 773 bp, Homo sapiens
ggctgatttaactctccaggtatgtaatcacatcatatacaggagatatttttgtctcttctttttcagtatttatttccattggggtgtctttatcttttctgtcgttgtttttaaaaactttccagacaatgttaaataataatatttttatgaatgatttcaatgacaatgataatagtaggcatctttatatattctgaatgtagaggaattattgctaatttaaatatggatgctctatgctgttaaccggaattctttttaattctagttctgaaatttttattaggaatgattgttgatttctataaaatacctgtcaagtatgcactaaaattataagatgcttttcctgcttagcgtcttgatgtggtgtagcatattaatagaaccccttatatgaggcaacacttgcttgcaaccctggggtaatcccactttgtcatggtataattttagtgtatatatcattgaatacactgcctattccttcctatgacctatctgtgctcatggtccgctcagtctagccccctctatccctgacttggtcctgccctgactgtggtccagagagctgtggggcagaggccagggtgtgtgtgcatgtggtggttgttgggggcatgggatggggggtgtcaaagcacctgatgatgatttcgccagcatcacaacctcaagtacgatatggtgtctcatccttttaagttttagtttttaacaggatatgttaaaaactaacatatttagtttaacaggatatgcct

SEQ ID NO: 46310 - DNA, 355 bp, Homo sapiens
aaatccagagctgatgttctgaaaccacctcaccatactgtcctttagcctccgcatggccattcgtgcttggtgtgatagtgcttagataccttaaggtatttgggaaattttagaaccatgttcagcatcgacttagagtcaccaatacagtctagccttttaaaatgtagtgtgatactagcatactaagatgaacctttcgttacattacttattgtatcagggccacagacatctcagaaacctggagttgagtatccctcctctagatgctgaatcacaagttggtatccatgtttgctgtgttttgaatggctaaaatatcttcctttgtattgcctgtaaactcaac

SEQ ID NO: 46311 - DNA, 416 bp, Homo sapiens
agtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttcc

SEQ ID NO: 46312 - DNA, 408 bp, Homo sapiens
ctagctatgtgaccttgacctagccaaaccacggtttccttatctgtaaaatggaggtgatgaaatctctttcttacctaccccccatcatcgcggggagacctgaaggcatgacagatgtggcggtcctttataaaatgctgtatcacctcactagcagaatatggtccacagaccagcaacatggccatctcccagagtttattagaactgcagaacctcaggctcctcccaggcccagtgaatcagaatctgcatgttaatacgattcccagggcgattcgtgtgcacatttatgtttgagaagcacgtctatcataagactgtaaattgttgacatttactcagcagctgtctctccagcactggggagctttgccggggttaaaggagcagaatttgtgatcc

SEQ ID NO: 46313 - DNA, 432 bp, Homo sapiens
ctcctaattcttcattcctgcaagaagcatcacgcacttttctatggaactaagctattttgtctggacctctttaattctaccatcaggaagctgttgcagcaaatccttaaaagagatgatagcaattagagccatgatactgacattaaggatggcagtaagtgatagatgaagtgtttaaaaaataaaattcaactctttaatggtcaattgaatatgaagaaaaaagttgaagataaaattgctaagcagatttctggcttcatagcacattaagtatattaaaatgtatcccctgcctacattatatataatacttgatataaacagttatttataatagctcattgaaatttatttatgagcaattaaaatgcagtaatttgcccactgcactccagcctgggtgacagagcgagactccgtctc

SEQ ID NO: 46314 - DNA, 392 bp, Homo sapiens
tggggaagaagcagcatgcttcaggaagccttttattaactctctaatccattccagatgctgcagggtgcctggcctgggagccctggaaaggggtaaaggacgtagggaaaagatatgagattcaagagaaaatcttagattagataaatgtgagtgcaagagaaacatctgggttgtccagttggggaaaatgaggcctaacgtccagatgtggtggggatgggacagcttctgctgatttagcttcagctcagactgggagccctgatgatcccttatctggttaatgggtttatcctgggaggcgggtggggctggcaggagccgggcagggcagaaggtacccccctagctggaatggctgtctcatctcaggcagagaccagaga

SEQ ID NO: 46315 - DNA, 510 bp, Homo sapiens
tgcttcctgtaaatacattagaaattataaaatttcttttaagtgctaatttaacattgtttcacaaagtgtgacatttttgtttttattttcatttggttctaaatattttgtaaccctcttctggtttacttttaaacccaagggatatttagtaatgtcatttcctttccaaaaatgtggtattttaaaacttctatccttttgttatttatttcaaaatttattttactattacattagaacacactttgttgctttagagtttattgtgtttctttcttgctaaatacatttttcatgatatatgatcaaattgtgtaaacattctatgcatttttaaaagtatagtctccagcctgggcgacagagcaagatttgtctcaaaaaataaaaataaaataaataaataaataaactttaaacggcatcctcagctcaacttgttcttgttcaggggttgcagtccttgggtaaataaaataaataaataaataaactttaaacagt

SEQ ID NO: 46316 - DNA, 375 bp, Homo sapiens
caatcttgctctgtcactcaggctatagagtacagtagtgcagtcataacttagtgtaacctcaaactcctgtgctcaagtgatgtccccctcctcagcctccacgagtagctggaactacaggtgtgcactaccatagcagactaattttcttattttcttttgttttttgtttttttttctgtaaaaacaagatttctccatgttgcctgggctggtcttgaagtcctgacctcaagcgatcctcccacctcagcctctcaaagtactgggattataggcatgagctaccatgcccagcctcctctgttaatggatcttgaaacaggcattaaaacttccttaatttaaacacggtttgttttcttacaagaa

SEQ ID NO: 46317 - DNA, 344 bp, Homo sapiens
ctgggtcaaaggcagcagcactctgctgtgaacagtccttcagggacccaagttgatgaggggcctgccatctctaatgctggctctcaaaatcccctgggcattggtctcccgctggtagaacaggaaaaggagcatgcatgggaggtttttatgggccaggcttggaaatggtgccattatattccgccaactagaactcagtcacatggccacacctgtgtatctgcaaggcaagctgggaaatgtcatttatctctgtgcccagagaaaaagagggcatggatttggcaaacagagagccagaaccagtctctgccacaagaaatcacatatttacactg

SEQ ID NO: 46318 - DNA, 349 bp, Homo sapiens
ctcatgattatgctgtggagaaagaccacagaggcaaattgccattttaaccaaattctatcaaagacacatattatcaacatgacttttcactgttgatgttgagcatggtcacctaactaaggtagtattcttcaggtttcaaaatttattcattttctcccttcctattctgtattctttggaagtttctaagagtagctaacacataaagagtggagtgtatctacataaattatttggaattgttctgcacaggagatttgtctttctcccccatttgcttatttaatcttttaatttatatcagtgtgaactcatggatatttattttataatttggataaca

SEQ ID NO: 46319 - DNA, 462 bp, Homo sapiens
ttttccctaagtgtcttgtggtattcactgaataccactctgcaggagacctgcagagtgaagggcgagatcaaggcgggttgtgggcaggcaggctttatgggagtgtacatgtagcttcctttcagttttctcagaaacaaatgagaacagtactttgaaactcaatgccttaacttcaattttaacagcctactaaagcaaggattaattcttcttacacttttaccaataaaaataatagtggtggtgtttaagctttgggcctttaccatgtgcctggtattgtgctgagcatttcataaatattatctcctggaatcttcatctaaaccaaagggaaagactttcctttaaggactggtactgagtgtcaccagatctcttcatgcccatgattgtgtatccatggtaactaacataattttactttctgtctttttggtgtgtcattaatgcagt

SEQ ID NO: 46320 - DNA, 900 bp, Homo sapiens
ggatgggagtaaatatttagacgtggttctcaggtgctgtagaatttaataaccttgcagcagttttagaaactccttgtgcccactggaacaggttcgtttaaagaatcttacttgggctcttttgaaattgtgatgcccccacctccacccactcccctcccccgcccacccccagacctgccctgagttcatctgcctaatgttccctttgcaggatctttgtactcacatggctggtatctttgccccacccccttatgccatatattttgacctcattgtgttctattctgaaacgcctgggttttgaaacatcgtggtgaatgttttctttttcaaagggcaaatctccatcttttgctctcctcccttaagccagggctgttttgatgactgatattctgcacaccactggactaaccaaccatctgtactttgatcccagaattcattttgattctgctgtttgtttagaactgaaagctttctagcttgtttggatgtggttgtgattcagtgaaactggcactgattttccatctgtttgccattggttgggacttctccaatgtgttaggaaagctgctgtgctgagttgcgaagagaaattcacatgtccatggtcttgcacaagggctcatttgctcacttagaaggttttatgtagagcctctgcctgggtgaaagacatgagcttccctggaaacaattgaaaaacatcttctgcctggccactcagtcttgagctctagtaggttacactgtttttcccttctgggcttctttttgaggaaggggagtgtggatgggaagaaatcttcacaatcagtctcagattcccagcagcagagagtgaattgtatgttgtaataataaaaaaaagaatacctaaagaac

SEQ ID NO: 46321 - DNA, 859 bp, Homo sapiens
tgttatactttccttccttctcatcattagtgtgaaaaggttctaaggtggaacgcaccagagcccacacttgtcccattgttaccctgatgtttccgagctccccttcttactcaccatggggattgcttaagggtactcgggtgtcctccagcttagttccacattctccaaccatcactccagcgacccttcaactggggttcaagccccacgttgggcgccacttgccgacaccagctcggtcttggagaccctaacccagcggcgctagaggaattaaagacacacacacagaaatatagagtgtggagtgggaaatcaggggactcacagccttcagagctgaaagccccgaacagagtttgactcacatgtttattgacagcaagccagtgataagcattgtttctaaagattatagattaactaaaagtattccttatgggaaacaaagggatggactgaaacaaagggatgggctctggctagttatctgccacgtccttaaggcacagctcgctcatgctattgtttgtggcttaggaacaccttaagaggttttcccccctgggtgggacaggtgttccttgccctcattccagtaaatccacaaccttcagtgtgtgcatcatggccatcatgaacatgtcacagtgctgcagagattttatttatggccagtttatggccagatttgggggcctgttcccaacagcagattctatgaccacttcagccctgcctttacagtttctgtttacctgtaaactttttcttcctgtggcctagggtagttcaggatcactaaaaatgtgttctgtgatatattaataaaaattcctgaaaaatggactta

SEQ ID NO: 46322 - DNA, 405 bp, Homo sapiens
aatatacatatttcattgctttcttccaccgaaaaatccaagaaacaatgacaacctattagtaatgagcatccctactacccagtttgtgttttctaaataccatttcctactaaaaggaatcaagatttcttgaaatggttgattccacgtcggatgctgtacatgttcaaaatgagcttgaaataccttgttctttcggaaaacaagaaagttatcaaaggcttctagggtcagatcaaaagagcaaagagcccccttaaaaatgcaaactctaggctgggtgcagtggctcacatctgtaatcccagcactttgggaggcctaggtggctggatcgcctgaggttgggagttcgagaccagcctggccagcatggtgaaaccccgtctttactaaaaatgc

SEQ ID NO: 46323 - DNA, 1506 bp, Homo sapiens
ctccatttctgaaagggtgccttaaaaggaattcatttgtctgatccatccttttgcctttgggcattactactgtcaccctccatttctttacaaacttcaggcaaggtggtctctctctctctcccaataggcaattccaggttgtaaactcattatcaggaagcttaatcttagaactgaaatacctcacagagcaatttaaacctctttcttcttgttcctattcttcatgggaagaaaactgggttgatccctatcttctttttaaggagccacatttgccatttattattgctcttttgcctatttaaaaaaaataacagtcagaaaaaataatgattattaaaatgatagtcattatttacttagtgaatgtcaggataggtatttattactcttagcttcttattggtatcagatgtagatcacggtcttactgttgattaactcttcagttatatatacatactttgattctttagttacataattgataacaaagtgtgcttctgaagaattattctggctgtatggctcttgtttcctccccttggtaaaaatggaggcatgaatctcagttttgtgatctgcttttaatttcatatatgacattatttgatgtacataattaccaacatccaaaagcgtttcttcccctttctacgtgtgcactaaattctaaaacaaaaattggaatacaaaatgcctaataaagaaaaaattcatgtacagaaaagcaaaagataatctactttgttaagataatttgtcactagctggttgaataatgcacagtttttgtttaaggttacacatttatgcctggattaaataacaatagtaaaacttgacaagtcttttgaaaaacagctgctaaacatattgctttctggaatgtaatcattagcaacaaatattctcttattctatacaattgcagaatgctagtggaactttcttgtaggttatttgacaatgaatgttaattgatttattttttaaaaatgtaaaatcctcttatccctttaaggccggtttaggctttcatgtccctgtgatagaaaatttcaaatgctggcttctaatttctactcactgaagtgtcttccagacataccagatggttggagctcctttgatagtatataagggagctacataaatgtatttgaactaactcgtgagcaaaatttctgttttcagcaaaaaaaaaaaaaaaagaaaaaacaacaaactctgctcaaaatttcagataatacaggagtaaaaagaggtttttgataatctgaagggaaaagtgtgccccatatatcttgtacacacttttaatgcatgacttttagtatagagatgaaataaaatgcaaaatatataattctggagatctcagcagctagttaaaatatttagagaagctgctttatgaagacttagagaatccttgatctcccccacatttcctatcactccattgaaacatggatctttaatattaatacatac

SEQ ID NO: 46324 - DNA, 3766 bp, Homo sapiens
attgctggttcaaatggtagttctgttttaacttctttgagaaatctccaaactgctttcacagtggctgaactaatttgcatttccatcagtgtaggcgcattctacactgcactggcttctacagtgttgaagcattccgtttttcccacagcctcaccagcatctgttatttttttgactttttgataatagccattctgactggtgtgagattgtaactcattgtggttttgatttgcatttatctgattagtaatgttgagcattttttcatgtttgttaaccgcttgtatgttgtcttttgagaagtgtctgttcaagtcttttggcatttttttaatgggtttttgtttgtgtgtgtgtatttttgtttttgtttttgttttgagatggagtttcactgttgtcacccaggctagagtgcaatggcaccatctcagctcactgcaacctccacctcccgggttcaagcgattctcctgccccagcctcctgagttgctgggattacaggtgcctgccaccaagcgtggctaattttggtacttttagtagagacagggtttcaccatgttggccagcctggtctcgaattcctgacctcaggtgatccacccatctcagcctcccaaagtgctgggattacaggagtgagccaccacacctggccacgagttacttggttttcgttttctgaattgttttagttccttatagattttggacattagacctttttcagatgcacagtttgtgaatattctctcccattctgtaggttgtctgtttactgtattgatagttccttttgcggtgcagaagctctttagtttgattaggttccacttgtcaatttttgtttttgttgcaattgcttttgaggacttagccgtaagttctttcccatagctgatgtccagatgttatttcgtaggttttcttctaggactcttatagcttgaagtcttacatttaaatcttttttttttttttccccaaagacagagtctccttctgttgcccaggctggagtacagtggtacaatcttggctcaccacaacctccacctcccaggctcaagcgattctcatgcctcagcctcccaacctaactgggattacaggcacatgccaccacgcctggctaatttttctatttttagtaggaatggggttttaccatgttggccaggctggtcttgaattccgagcctcaagtgatccacccacctcagtctcccaaagtgctgggattacaggcatgagccactgcacccggccccttatatttaaatctttaatctatcttgaggtaattttatatatatggtgaaaggggtccagtttgagtcttctgcatatggctagacagctgttccagcaccatttattgaattagggaatcctttctctgttgcttatttttgttaactttgtcaaaggtcagatggctgtaggtgtgtagctttatttctgtctgttccattccattggtctatgggtctgtttttatatctgtaccatgctgttttggttactgtagcttccttatagtatagtttaactcaggtaatgtgatacctcagctttgttttatttgcttaggattgattttttggttccatatgaattttagaatggattttttctttttttttttttgagacggagtcttgctgtgtctcccaggctctgagtgcagctgtgcaatctcagctcactgcaacctctgcctcctgagttcaagcaattctcctgcctcagcctcccaaatagctgggattacaggagcccgccaaccatgcccagctaatttatgtaattttagtagagatggggtttcatcatcttagccaggctggtcttgaactcctgacgttgtgatccacccgcctcagcctcccaaagtgctgggattacaggcgtgagccactggacccggcaggatttttctaattctgtgaaaaatgatgtttgtagtttgataggaatagcattgaatctgtggattgctttgggcagtatggccattttaatgatattgattcttctagctcatgagcttggaatgtttttccatttgtttgtgtcatctctgatttctttcagcgtgttttgtagttcttgtccagctcacattttatcttcatactttgagtagcctccttccatgaatggatcatccagtggccgcacttaggttctcctatgaagatttttgttgtattgtacctcagaaccatctccatattctctaaataataataatgatggtcataaattgaatagaagtatttactagatgaggaggaaaaccctaaaacaaaacatgaacataaaatatttttaaaaggaagacatacaaacagacactataaccaaataagatgacagaattaaggccttatgccacagccagagttgaaaaatgcagaaaaaaagtttaaaaacaaggaattaaagccaaacctaacttttatcaaaataaatgtaaaagtgatgaaagaatctgttaagatatcagattgtaatataaaagatactagaaacaaatgccaatagaacacttaagtacattttatatattcatccattagaatatatagctgtcagaatgatagaagaattacatatgtgtgcaaaagtttttgtatccatgtggaaaacacaggaagctaatagtactgtttttctctggagtgggtgtaagggtagagacttaactctttacatccttatggcagccttcgaataccttttaactcccagttcccttaactgggggtgtgtatcctagaatcctcgacccattagaaagtatattgtagacatcatactctttaccctttaacactacacatgcacttcataagaacaagcatgctgtcttacccaagtacagctatcaagttcagaaatttaacattgccataatactttacagtccatatttcaatttcatttgctgttttattggtaatttttttcagctccacgatccagcctaggatcatatgttgtattgccataaccctctaatctggagcagttcctcagcttttctttgttttttataatagtaatatatttgaaaaatacaggacagctaaaggatagagtatccttctatttgggtttttctgatgtttcctcatggttagattggggtagtgcagtgagggttgaaatgctgtaagtgatatgtattgcaggtatacatccagatgcacagaatgtccatttgtcccttattggtgatgctaattttgatcacttgggtaagatgtccagtttctccagtgtatcgttattgtttttccttttgcaattagtgggtaatttgtgaggagaaactttgagaccttgttgacaattctgttcctcatcaaatctacccctcctaggtttagcatcctttgacgattcttgtctgaataaatttttactaggatgtttccaaaattgtgattgttctaactctattattatttctgtattaattagtcatcattctactgtaaggaagaggtttccctttatcatcaacttcgagtaagtacttttttctgagccatttgaatattccttactagatgtggtgcctctttaccccaattacttaagtttgtatttccaaagaacaagggtgttttcctgcatagccatagcacaattaccaaaatcagaaaattaacattaatactttactattatcaaatctttttcatattttgctaattgtttcagtaatatgcaaaaaaaaa

SEQ ID NO: 46325 - DNA, 3776 bp, Homo sapiens
attgctggttcaaatggtagttctgttttaacttctttgagaaatctccaaactgctttcacagtggctgaactaatttgcatttccatcagtgtaggcgcattctacactgcactggcttctacagtgttgaagcattccgtttttcccacagcctcaccagcatctgttatttttttgactttttgataatagccattctgactggtgtgagattgtaactcattgtggttttgatttgcatttatctgattagtaatgttgagcattttttcatgtttgttaaccgcttgtatgttgtcttttgagaagtgtctgttcaagtcttttggcatttttttaatgggtttttgtttgtgtgtgtgtatttttgtttttgtttttgttttgagatggagtttcactgttgtcacccaggctagagtgcaatggcaccatctcagctcactgcaacctccacctcccgggttcaagcgattctcctgccccagcctcctgagttgctgggattacaggtgcctgccaccaagcgtggctaattttggtacttttagtagagacagggtttcaccatgttggccagcctggtctcgaattcctgacctcaggtgatccacccatctcagcctcccaaagtgctgggattacaggagtgagccaccacacctggccacgagttacttggttttcgttttctgaattgttttagttccttatagattttggacattagacctttttcagatgcacagtttgtgaatattctctcccattctgtaggttgtctgtttactgtattgatagttccttttgcggtgcagaagctctttagtttgattaggttccacttgtcaatttttgtttttgttgcaattgcttttgaggacttagccgtaagttctttcccatagctgatgtccagatgttatttcgtaggttttcttctaggactcttatagcttgaagtcttacatttaaatcttttttttttttttccccaaagacagagtctccttctgttgcccaggctggagtacagtggtacaatcttggctcaccacaacctccacctcccaggctcaagcgattctcatgcctcagcctcccaacctaactgggattacaggcacatgccaccacgcctggctaatttttctatttttagtaggaatggggttttaccatgttggccaggctggtcttgaattccgagcctcaagtgatccacccacctcagtctcccaaagtgctgggattacaggcatgagccactgcacccggccccttatatttaaatctttaatctatcttgaggtaattttatatatatggtgaaaggggtccagtttgagtcttctgcatatggctagacagctgttccagcaccatttattgaattagggaatcctttctctgttgcttatttttgttaactttgtcaaaggtcagatggctgtaggtgtgtagctttatttctgtctgttccattccattggtctatgggtctgtttttatatctgtaccatgctgttttggttactgtagcttccttatagtatagtttaactcaggtaatgtgatacctcagctttgttttatttgcttaggattgattttttggttccatatgaattttagaatggattttttctttttttttttttgagacggagtcttgctgtgtctcccaggctctgagtgcagctgtgcaatctcagctcactgcaacctctgcctcctgagttcaagcaattctcctgcctcagcctcccaaatagctgggattacaggagcccgccaaccatgcccagctaatttatgtaattttagtagagatggggtttcatcatcttagccaggctggtcttgaactcctgacgttgtgatccacccgcctcagcctcccaaagtgctgggattacaggcgtgagccactggacccggcaggatttttctaattctgtgaaaaatgatgtttgtagtttgataggaatagcattgaatctgtggattgctttgggcagtatggccattttaatgatattgattcttctagctcatgagcttggaatgtttttccatttgtttgtgtcatctctgatttctttcagcgtgttttgtagttcttgtccagctcacattttatcttcatactttgagtagcctccttccatgaatggatcatccagtggccgcacttaggttctcctatgaagatttttgttgtattgtacctcagaaccatctccatattctctaaataataataatgatggtcataaattgaatagaagtatttactagatgaggaggaaaaccctaaaacaaaacatgaacataaaatatttttaaaaggaagacatacaaacagacactataaccaaataagatgacagaattaaggccttatgccacagccagagttgaaaaatgcagaaaaaaagtttaaaaacaaggaattaaagccaaacctaacttttatcaaaataaatgtaaaagtgatgaaagaatctgttaagatatcagattgtaatataaaagatactagaaacaaatgccaatagaacacttaagtacattttatatattcatccattagaatatatagctgtcagaatgatagaagaattacatatgtgtgcaaaagtttttgtatccatgtggaaaacacaggaagctaatagtactgtttttctctggagtgggtgtaagggtagagacttaactctttacatccttatggcagccttcgaataccttttaactcccagttcccttaactgggggtgtgtatcctagaatcctcgacccattagaaagtatattgtagacatcatactctttaccctttaacactacacatgcacttcataagaacaagcatgctgtcttacccaagtacagctatcaagttcagaaatttaacattgccataatactttacagtccatatttcaatttcatttgctgttttattggtaatttttttcagctccacgatccagcctaggatcatatgttgtattgccataaccctctaatctggagcagttcctcagcttttctttgttttttataatagtaatatatttgaaaaatacaggacagctaaaggatagagtatccttctatttgggtttttctgatgtttcctcatggttagattggggtagtgcagtgagggttgaaatgctgtaagtgatatgtattgcaggtatacatccagatgcacagaatgtccatttgtcccttattggtgatgctaattttgatcacttgggtaagatgtccagtttctccagtgtatcgttattgtttttccttttgcaattagtgggtaatttgtgaggagaaactttgagaccttgttgacaattctgttcctcatcaaatctacccctcctaggtttagcatcctttgacgattcttgtctgaataaatttttactaggatgtttccaaaattgtgattgttctaactctattattatttctgtattaattagtcatcattctactgtaaggaagaggtttccctttatcatcaacttcgagtaagtacttttttctgagccatttgaatattccttactagatgtggtgcctctttaccccaattacttaagtttgtatttccaaagaacaagggtgttttcctgcatagccatagcacaattaccaaaatcagaaaattaacattaatactgaaacaataggcaaaatatgaaaaagatttgataagtcgagcgggggttaatttagtagtagtagtaagc

SEQ ID NO: 46326 - DNA, 3712 bp, Homo sapiens
attgctggttcaaatggtagttctgttttaacttctttgagaaatctccaaactgctttcacagtggctgaactaatttgcatttccatcagtgtaggcgcattctacactgcactggcttctacagtgttgaagcattccgtttttcccacagcctcaccagcatctgttatttttttgactttttgataatagccattctgactggtgtgagattgtaactcattgtggttttgatttgcatttatctgattagtaatgttgagcattttttcatgtttgttaaccgcttgtatgttgtcttttgagaagtgtctgttcaagtcttttggcatttttttaatgggtttttgtttgtgtgtgtgtatttttgtttttgtttttgttttgagatggagtttcactgttgtcacccaggctagagtgcaatggcaccatctcagctcactgcaacctccacctcccgggttcaagcgattctcctgccccagcctcctgagttgctgggattacaggtgcctgccaccaagcgtggctaattttggtacttttagtagagacagggtttcaccatgttggccagcctggtctcgaattcctgacctcaggtgatccacccatctcagcctcccaaagtgctgggattacaggagtgagccaccacacctggccacgagttacttggttttcgttttctgaattgttttagttccttatagattttggacattagacctttttcagatgcacagtttgtgaatattctctcccattctgtaggttgtctgtttactgtattgatagttccttttgcggtgcagaagctctttagtttgattaggttccacttgtcaatttttgtttttgttgcaattgcttttgaggacttagccgtaagttctttcccatagctgatgtccagatgttatttcgtaggttttcttctaggactcttatagcttgaagtcttacatttaaatcttttttttttttttccccaaagacagagtctccttctgttgcccaggctggagtacagtggtacaatcttggctcaccacaacctccacctcccaggctcaagcgattctcatgcctcagcctcccaacctaactgggattacaggcacatgccaccacgcctggctaatttttctatttttagtaggaatggggttttaccatgttggccaggctggtcttgaattccgagcctcaagtgatccacccacctcagtctcccaaagtgctgggattacaggcatgagccactgcacccggccccttatatttaaatctttaatctatcttgaggtaattttatatatatggtgaaaggggtccagtttgagtcttctgcatatggctagacagctgttccagcaccatttattgaattagggaatcctttctctgttgcttatttttgttaactttgtcaaaggtcagatggctgtaggtgtgtagctttatttctgtctgttccattccattggtctatgggtctgtttttatatctgtaccatgctgttttggttactgtagcttccttatagtatagtttaactcaggtaatgtgatacctcagctttgttttatttgcttaggattgattttttggttccatatgaattttagaatggattttttctttttttttttttgagacggagtcttgctgtgtctcccaggctctgagtgcagctgtgcaatctcagctcactgcaacctctgcctcctgagttcaagcaattctcctgcctcagcctcccaaatagctgggattacaggagcccgccaaccatgcccagctaatttatgtaattttagtagagatggggtttcatcatcttagccaggctggtcttgaactcctgacgttgtgatccacccgcctcagcctcccaaagtgctgggattacaggcgtgagccactggacccggcaggatttttctaattctgtgaaaaatgatgtttgtagtttgataggaatagcattgaatctgtggattgctttgggcagtatggccattttaatgatattgattcttctagctcatgagcttggaatgtttttccatttgtttgtgtcatctctgatttctttcagcgtgttttgtagttcttgtccagctcacattttatcttcatactttgagtagcctccttccatgaatggatcatccagtggccgcacttaggttctcctatgaagatttttgttgtattgtacctcagaaccatctccatattctctaaataataataatgatggtcataaattgaatagaagtatttactagatgaggaggaaaaccctaaaacaaaacatgaacataaaatatttttaaaaggaagacatacaaacagacactataaccaaataagatgacagaattaaggccttatgccacagccagagttgaaaaatgcagaaaaaaagtttaaaaacaaggaattaaagccaaacctaacttttatcaaaataaatgtaaaagtgatgaaagaatctgttaagatatcagattgtaatataaaagatactagaaacaaatgccaatagaacacttaagtacattttatatattcatccattagaatatatagctgtcagaatgatagaagaattacatatgtgtgcaaaagtttttgtatccatgtgggacttaactctttacatccttatggcagccttcgaataccttttaactcccagttcccttaactgggggtgtgtatcctagaatcctcgacccattagaaagtatattgtagacatcatactctttaccctttaacactacacatgcacttcataagaacaagcatgctgtcttacccaagtacagctatcaagttcagaaatttaacattgccataatactttacagtccatatttcaatttcatttgctgttttattggtaatttttttcagctccacgatccagcctaggatcatatgttgtattgccataaccctctaatctggagcagttcctcagcttttctttgttttttataatagtaatatatttgaaaaatacaggacagctaaaggatagagtatccttctatttgggtttttctgatgtttcctcatggttagattggggtagtgcagtgagggttgaaatgctgtaagtgatatgtattgcaggtatacatccagatgcacagaatgtccatttgtcccttattggtgatgctaattttgatcacttgggtaagatgtccagtttctccagtgtatcgttattgtttttccttttgcaattagtgggtaatttgtgaggagaaactttgagaccttgttgacaattctgttcctcatcaaatctacccctcctaggtttagcatcctttgacgattcttgtctgaataaatttttactaggatgtttccaaaattgtgattgttctaactctattattatttctgtattaattagtcatcattctactgtaaggaagaggtttccctttatcatcaacttcgagtaagtacttttttctgagccatttgaatattccttactagatgtggtgcctctttaccccaattacttaagtttgtatttccaaagaacaagggtgttttcctgcatagccatagcacaattaccaaaatcagaaaattaacattaatactttactattatcaaatctttttcatattttgctaattgtttcagtaatatgcaaaaaaaaa

SEQ ID NO: 46327 - DNA, 3711 bp, Homo sapiens
attgctggttcaaatggtagttctgttttaacttctttgagaaatctccaaactgctttcacagtggctgaactaatttgcatttccatcagtgtaggcgcattctacactgcactggcttctacagtgttgaagcattccgtttttcccacagcctcaccagcatctgttatttttttgactttttgataatagccattctgactggtgtgagattgtaactcattgtggttttgatttgcatttatctgattagtaatgttgagcattttttcatgtttgttaaccgcttgtatgttgtcttttgagaagtgtctgttcaagtcttttggcatttttttaatgggtttttgtttgtgtgtgtgtatttttgtttttgtttttgttttgagatggagtttcactgttgtcacccaggctagagtgcaatggcaccatctcagctcactgcaacctccacctcccgggttcaagcgattctcctgccccagcctcctgagttgctgggattacaggtgcctgccaccaagcgtggctaattttggtacttttagtagagacagggtttcaccatgttggccagcctggtctcgaattcctgacctcaggtgatccacccatctcagcctcccaaagtgctgggattacaggagtgagccaccacacctggccacgagttacttggttttcgttttctgaattgttttagttccttatagattttggacattagacctttttcagatgcacagtttgtgaatattctctcccattctgtaggttgtctgtttactgtattgatagttccttttgcggtgcagaagctctttagtttgattaggttccacttgtcaatttttgtttttgttgcaattgcttttgaggacttagccgtaagttctttcccatagctgatgtccagatgttatttcgtaggttttcttctaggactcttatagcttgaagtcttacatttaaatcttttttttttttttccccaaagacagagtctccttctgttgcccaggctggagtacagtggtacaatcttggctcaccacaacctccacctcccaggctcaagcgattctcatgcctcagcctcccaacctaactgggattacaggcacatgccaccacgcctggctaatttttctatttttagtaggaatggggttttaccatgttggccaggctggtcttgaattccgagcctcaagtgatccacccacctcagtctcccaaagtgctgggattacaggcatgagccactgcacccggccccttatatttaaatctttaatctatcttgaggtaattttatatatatggtgaaaggggtccagtttgagtcttctgcatatggctagacagctgttccagcaccatttattgaattagggaatcctttctctgttgcttatttttgttaactttgtcaaaggtcagatggctgtaggtgtgtagctttatttctgtctgttccattccattggtctatgggtctgtttttatatctgtaccatgctgttttggttactgtagcttccttatagtatagtttaactcaggtaatgtgatacctcagctttgttttatttgcttaggattgattttttggttccatatgaattttagaatggattttttctttttttttttttgagacggagtcttgctgtgtctcccaggctctgagtgcagctgtgcaatctcagctcactgcaacctctgcctcctgagttcaagcaattctcctgcctcagcctcccaaatagctgggattacaggagcccgccaaccatgcccagctaatttatgtaattttagtagagatggggtttcatcatcttagccaggctggtcttgaactcctgacgttgtgatccacccgcctcagcctcccaaagtgctgggattacaggcgtgagccactggacccggcaggatttttctaattctgtgaaaaatgatgtttgtagtttgataggaatagcattgaatctgtggattgctttgggcagtatggccattttaatgatattgattcttctagctcatgagcttggaatgtttttccatttgtttgtgtcatctctgatttctttcagcgtgttttgtagttcttgtccagctcacattttatcttcatactttgagtagcctccttccatgaatggatcatccagtggccgcacttaggttctcctatgaagatttttgttgtattgtacctcagaaccatctccatattctctaaataataataatgatggtcataaattgaatagaagtatttactagatgaggaggaaaaccctaaaacaaaacatgaacataaaatatttttaaaaggaagacatacaaacagacactataaccaaataagatgacagaattaaggccttatgccacagccagagttgaaaaatgcagaaaaaaagttttgaaagaatctgttaagatatcagattgtaatataaaagatactagaaacaaatgccaatagaacacttaagtacattttatatattcatccattagaatatatagctgtcagaatgatagaagaattacatatgtgtgcaaaagtttttgtatccatgtggaaaacacaggaagctaatagtactgtttttctctggagtgggtgtaagggtagagacttaactctttacatccttatggcagccttcgaataccttttaactcccagttcccttaactgggggtgtgtatcctagaatcctcgacccattagaaagtatattgtagacatcatactctttaccctttaacactacacatgcacttcataagaacaagcatgctgtcttacccaagtacagctatcaagttcagaaatttaacattgccataatactttacagtccatatttcaatttcatttgctgttttattggtaatttttttcagctccacgatccagcctaggatcatatgttgtattgccataaccctctaatctggagcagttcctcagcttttctttgttttttataatagtaatatatttgaaaaatacaggacagctaaaggatagagtatccttctatttgggtttttctgatgtttcctcatggttagattggggtagtgcagtgagggttgaaatgctgtaagtgatatgtattgcaggtatacatccagatgcacagaatgtccatttgtcccttattggtgatgctaattttgatcacttgggtaagatgtccagtttctccagtgtatcgttattgtttttccttttgcaattagtgggtaatttgtgaggagaaactttgagaccttgttgacaattctgttcctcatcaaatctacccctcctaggtttagcatcctttgacgattcttgtctgaataaatttttactaggatgtttccaaaattgtgattgttctaactctattattatttctgtattaattagtcatcattctactgtaaggaagaggtttccctttatcatcaacttcgagtaagtacttttttctgagccatttgaatattccttactagatgtggtgcctctttaccccaattacttaagtttgtatttccaaagaacaagggtgttttcctgcatagccatagcacaattaccaaaatcagaaaattaacattaatactttactattatcaaatctttttcatattttgctaattgtttcagtaatatgcaaaaaaaaa

SEQ ID NO: 46328 - DNA, 2144 bp, Homo sapiens
caacaaaactctgcctttggcttttgctggctgagcagggaaagacctatagacacagggcattgggcaggagctagaacagccctccctagagcactacataaagcagccaatattttgcaaagcatagggaagagtgaaagtcatccggggcatttgcagacacagcactaagaacttggtgacaacagccctgaagcaaaacagcagcatgtactgggcagggcttgggagataagacaggacatctgaagctaaacatggatcccctctgaaagctacaatcaaagtgtcatccacaaaatcttatctcaagccttgactagagaaggacccacttccaagaccacagagttgaatgaattcagtccttgcagcccgttgaactgagggcctccccaacatgctcacctgcttcatcaaagcctgcgagagagagagtccactagcaagaggacattgcagtcttatctaatgcaatcactgaagtgacatcctgtcaccttggtcaccttttctattctattcattataaatgagtcccaagtcctgccacactcaagtggaggggattacacagggctggagtaccagcggtggggataatttggggtcatcttagagttcttccatcacacgggaattctcagctcaccaaatctgggattccgcatctggccattccttaagctgaaggcctggcatatttttgagtgtccatttggatcagctaataaacccagggtttgtctactggctggaggagtaagaactataaggctaattgaaatgaatctacttaaaatagtgacctgatttttctaataattactggaaggtaagggttgattgagactttaaaataaaaccaaaaattattctaaatttttcatattttatataagaaagttttgatttttactgcaaccattttctaactcttaaaataaagaaaggataattcaagtgttgatattttcccaacataaatatacaggaacataatgtagcttacttgtattttatctttgatttacacaagagaatttttatacaaatattccaggctcattagttttcccaaaggcttctcataatcctttgatatttaaatcattccctctttcaagtcattttttatctgccttgtcgatactctttttgttaatttgcccaactcatctggatcttcctttgtcactggctctgtaaatttgagtatttctccaataatgctcctgtcaactttatgaaaccctttgtcttttgcaagatttaaaaattccctttataataagcattctacagtaagtgaagactcactagcaaatatatgagtgatggatcaagagagacaaagtgttaaaaattgacagatgcaacttttaaaaatgaaattcttggttaccatctaacaaagtaagtacaggacctgtatgctgaaaactacaaaacactaatgaaggaatcaaagaaagtgtaaataaatggagagatatactatgttcacgaattggaagtctcagaattattaaaatgtaaattctatccaaattgatctatagattcaacccaatcacaatcaaaatcctaactggctatataaattgacagctgattccaacattcacataaaaatccaaagaatgtagaagagccaaacagctttgagaaaaggagaaaaaagttaaaggattcacattatctgattccaaggcttcttataaagctacagtcattgagtcagtatggtactggcaaaaggagagacacattctatgtatctatctgtctatatatctatgtggaatataataaagagttcagaaatagatccacaaataagatcaattgaattttggcaaagatgaaaaaataattcaatggagaaaggacagaattttcaataaatgatgctgaaacaattagacatccatatgcaggaaaaaaatgtttgacctatatgttcattttatacaaaaaattaattcaaaaagaatcatagacctaaatgtaaaacataaaaacttttaaacttttaaaataaaatataggtaaaatcttcgtgacctacaattaggcagagttcttggagatgacatcaagaatttaattcataaaaagaaaaaatttataagttggat

SEQ ID NO: 46329 - DNA, 1171 bp, Homo sapiens
caacaaaactctgcctttggcttttgctggctgagcagggaaagacctatagacacagggcattgggcaggagctagaacagccctccctagagcactacataaagcagccaatattttgcaaagcatagggaagagtgaaagtcatccggggcatttgcagacacagcactaagaacttggtgacaacagccctgaagcaaaacagcagcatgtactgggcagggcttgggagataagacaggacatctgaagctaaacatggatcccctctgaaagctacaatcaaagtgtcatccacaaaatcttatctcaagccttgactagagaaggacccacttccaagaccacagagttgaatgaattcagtccttgcagcccgttgaactgagggcctccccaacatgctcacctgcttcatcaaagcctgcgagagagagagtccactagcaagaggacattgcagtcttatctaatgcaatcactgaagtgacatcctgtcaccttggtcaccttttctattctattcattataaatgagtcccaagtcctgccacactcaagtggaggggattacacagggctggagtaccagcggtggggataatttggggtcatcttagagttcttccatcacacgggaattctcagctcaccaaatctgggattccgcatctggccattccttaagctgaaggcctggcatatttttgagtgtccatttggatcagctaataaacccagggtttgtctactggctggaggagtaagaactataaggctaattgaaatgaatctacttaaaatagtgacctgatttttctaataattactggaaggtaagggttgattgagactttaaaataaaaccaaaaattattctaaatttttcatattttatataagaaagttttgatttttactgcaaccattttctaactcttaaaataaagaaaggataattcaagtgttgatattttcccaacataaatatacaggaacataatgtagcttacttgtattttatctttgatttacacaagagaatttttatacaaatattccaggctcattagttttcccaaaggcttctcataatcctttgatatttaaatcattccctctttcaagtcattttttatctgcctctgctccctttgaaaaaaaaaaaa

SEQ ID NO: 46330 - DNA, 455 bp, Homo sapiens
tgagagccacaatagggagcgtgcctttcaagagggtccctgggaaggaaatttacctgcgtgctccttggcagccaatgcaaggagagaaatagagcaagttttaccttattctgaaaaggaggaagtgtgcagacttatcattaagaactaactaaggaagtcattttgctgttccttatataactgtataaacttgcctgttgtatttctagatcaaccccctgcgaaaggaggatgagggtgtgtaccagtgccatgcagccaacatggtgggagaggctgagtcccacagcacagtgacggttctagatctgagtaaatacaggagcttccacttcccagctcccgatgaccgcatgtgatggagaaatgtacatgttctaagtcattttcagtattttacacccatgttatgagatatttgaggtggcttataagacctgtaaaaaaaa

SEQ ID NO: 46331 - DNA, 410 bp, Homo sapiens
ctggtcacaaactcctgccctcaggtgatcagcctacctcggcctcccaaagtgctgggattacaggcgtgagcccccacgccaggccgggatttcccttcttaaccatagccacaatactatcatcagatgaaaaacaaacaaacaaactctttgttgtcatcgagtctacaatctggttcatatccccagctgccacgtgcctgtgtcttgatcccccacacacgtgacagttggccgtttggctgggtctctgcatcaggccatgctccgtgcatggatgtcctatgtttacatctccttgatgtccctccctcctgtttttcccttgcagagtattactcatttcctcctagtcccctctagcatggattttcctggctgcattcctctgccctggggatttccta

SEQ ID NO: 46332 - DNA, 278 bp, Homo sapiens
atgaaggaaagctagactcaactctgtgaatagaagttgctatactgtaagtaaagcaacaattcagaatactgaatgagtttaaattgttttatatagcacccttttgggctagggttaattactagatctgacttggataatttgacactttgggaaatgaactctgttcttgagacttattcagtgtattttaaacatctgaggaagaaaacttaaatatgcacctatttatacctattctttctttaggtcaacatttaacacccactgcatac

SEQ ID NO: 46333 - DNA, 778 bp, Homo sapiens
cttgagcccaggaattcaagaccagcctggccaacatagaaagacatcatctgtaccaaaataaataaataaataaattagccaggcacggtgatacaagcctgtagtgccagctatttggaggctgaggcaggaggctcacttgaggccaggaattggaggcttcagtgagccatgatcatgccactacactccagcctgggtgacacagtgagatcttgtctcttaaaaaaccaaaaagaaaacttgtgctaagtaatgttaatcagggcctatttaacacaagtgatagaaactcagttcaaatggcttaaggtgaaaaggagtggattggctaatgtaaccaaaatgttcagggaagcctagtcaacatggcgaaaccccgtctctaccaaaaatacaaaaaattaggtaggcatggtggtgcacgcctgtagtcccagccactgcagaggctgaggtgggagaatcacctgagcctgggaagtcgaggctgcagtaagccaagattgtgccactaaactccagcctgggcaactggactgagaccctgtcagcaaaaaaataaaataaaaaaaaaaaaagtctggggaagggtgggttttacctcaggcatggctggatccaggtatggctcaagggtgcttttaggactccatctgagaccaggcatggtgtctcatgcctgtaattccagagctttgggaggcaaagatgtgaggattgcttgaggccaggagttttgggcaacatagtgagaccccatctctatatcaaa

SEQ ID NO: 46334 - DNA, 977 bp, Homo sapiens
ctgttgcagtccagcctgggtgacagagcaagaacctgcctcaaaaagaaaaaaaaaaaaaaaaagtcaagcattatttaattttttacaaaacctaatatacattttgctgctgaaaaggatgccattccttccaaaagaaacctctctataaacttaaagaataatttatataactgaggtggcataggaaaaatgagtttaatgctatcagcctgatggcatccttagctcaggtttcaaaccatcttaatgttccctaacatcttggtactcaagtgtggtccttggtccagcagcatgagcctaacctggcaagatggtagaaaagctaaacctcaggcccagaatgttagcgagagcctgggatgggcgcattcaaatttgtgaagcactatgaacatcttatttaatcattcatgttttaatttattaaatgtaaaatagatgcaagagcatgttacatgactcttttgagaagagataaggcatactaatcacttttgtccccgggagacagtctcaaataacatcttatatgtaaattacatcttctgggtggagcagtgcaatgactatgtacgacacttggccttaacagaaaatgtttatctagatgacaagtactaatgcctagtaggacattaaagagttacttgtcatcaccggagcccacttttgtaaaacatttaagaataaaaaacagtttggtgctattaataattacttccacaagagataggaaagtgagactaaagaataaaatgtaatgtttttaagtattctactggcatcttcaaagtgtgatagaagcaaccactgaaaagaatgtcctaggagagaaaaacagcagcaccagggtctctaagttcatatgtaaaaagaatagatacttctacattgtcttataggccaagtattaggggctaagaaacaaatcaatacttgaggatgatggtgtttgcttagagttcatc

SEQ ID NO: 46335 - DNA, 337 bp, Homo sapiens
cttcctggccttgtcgatggcatgcaaattctttgaatgtttgcaagtccctctctggaggagcagcaaaggcctgagtggctgaggaggcctattatttttgtttatattattttatatgaaattattacttatgttatttttgttattataaaaagatgtaaagtgtgacatcaaaaacatcaaacatgggagaaaaggaagttagagtgaaaagtttgtgtatgcaatcaaaattaactgttatcagcttaaattaacctgttataacatgttttatgtaagccacagggtagtcgtaaagcaaaagcctgtaatggatacacaaaagataaaa

SEQ ID NO: 46336 - DNA, 372 bp, Homo sapiens
tacctctgtaaatacctctgtctccaaatgagatttcatcctgagcagctgggggttaggacttcaatatatgaatttgacagggagggtagaaggagagaacagaattcaacccacagcagcaacaatctaatagcttcctgtgagcaagcaaagagaatgttcattgtcagtctcataggcgccattccctattcatacgttacttgtgctctctcatattccttgagtgttttaaattgtaaacattcaagtacaaacaaacttcgcttgattaccagagataaaaaagaaatgccttgtaatttggtgtcatgtgaatgttttaagtggatacctgaaaaattgtacttaagaatggcataagagctt

SEQ ID NO: 46337 - DNA, 593 bp, Homo sapiens
cagtgggtaaatacaacctctgtctagtttctcagccagaatatcaatgtgaggtgcctaaacagttttgggatggtggaagttttgctatctatttgttcttgctagaaaaattatattttgtgtaatagattttaaatgttccatattttaaatattttttcttgtataaaattattatatttgaaagatttctttaggttattattgaagttcagtaagaagcagtttatttagtatacattatattcacacagtaaaaagtgagtacaacttaaacctttggaaaattgagggtgggacaaaattttggtttaggagtacctttgtcatgttaatatttgcttttattgaattatcattttgtattgaaatataagaaactacagaaaacacagatacacagcttaacaagtgttatatagaaggtacccgtattactaccagtacttaaagaatagaaataggctgggcacggtgactcacgcctgtaatcccagcactttgggaggctgaggcaggcagatcacgaggtcaggagttcaagaccagcctggccaacatggtgaaaccctgcctctactacgatacaa

SEQ ID NO: 46338 - DNA, 329 bp, Homo sapiens
gagtcaccatgcccagccactttttttctaacaatttgacattaccacctccttagcacaaaaagtttatctctggggataagaacttctaaagagctacatagccatccaattatgaggggaagaggcatggcagagcttatttttaaatttttatttacttgtttgagactctgtctcaaagaaaagaagaagaaaaaaagccacatgtgaaggtaggcatagcctaaaaggaaaaccctaatcactgagttcatggaagaagaaaagattgccatttcctttcatagaactcaaatgggtattggtacaacctgtaatttaatttg

SEQ ID NO: 46339 - DNA, 389 bp, Homo sapiens
gctgacagtgggtaggtgggcatagggagaccctgaggctagtcctctccagccccgacccagggcactagactcatagttccctcctttcttgttgccttcttacttcattccagacttttctccgtattattattattattttggagatggagtcttgctctgtcacccagggctggagtgcagtggcgcagtctctactcactgcaacctctgcctcctggggttcaagcgattctcctgcctcaggctcccgagtagctggggactacagggtgcccgccaccacgcccggctaagttaagtatttttggtaggaaaccgggtttcgtcatgtttgaccaggggtagttcttgaactcctgactcaagtgatccacccacctcga

SEQ ID NO: 46340 - DNA, 208 bp, Homo sapiens
ctcttgtatcctccacaggttctgaggggttgaaatatagatgtaaaacctggccgggcacattggctcatgcctgtaatccaagcactttgggaggctgaggtgggaggactgattgaggccaagagtttgagaccagcctgggcaacacagtgagactctatctctacaaaaaatgtaaaaaattagctgggcctggtggcacaca

SEQ ID NO: 46341 - DNA, 2039 bp, Homo sapiens
gccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaagaac

SEQ ID NO: 46342 - DNA, 1470 bp, Homo sapiens
cttgtggaaatttgagaccagcaagtactatgtgactatcactgatgctccaggacacagagacttcatcaaaaacatgattacagggacatctcaggctgactgtgctgtcccgattgttgctgctggtgttggtgaatttgaagctggtatctctaagaatgggcagacccgagagcatgcccttctggcttacacactgggtgtgaaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaagaaaaaa

SEQ ID NO: 46343 - DNA, 528 bp, Homo sapiens
ttttgacaaatctatcttaaatgtcagtccaatatccacggcgacgagccacagcaggtgagaaacctggaaatgagcctgaagaggtgaagctgcagaatgccagcaaacagattgtgcagaatgcaatcctgcaagctgtgcagcaagtctcccaggagagtcagcgcagagaagagagaatcagtgacaaccgggaccacatccaactgggcgttggggagttaaccaagaagcacgaaaagaagtaacatggtggatttggctcttgacatgtgcttggtttctagccttcctcttagtataggacgcatctccaaaatgttgccagtaaagcaaaccgaagtgtcaccggcacctagctgtagaatgaattcacactagcccctggctgagaagcactgttttgaaaaagtgcattagacgattctgttcatatttatgcagtgcctctgagacatagtggggccaaatatgacactgtaattgcaaaagtagttttgcaggccaatttatttttaaagttct

SEQ ID NO: 46344 - DNA, 463 bp, Homo sapiens
  misc_feature (463)..(463): n is a, c, g, or t
taatttataagacatgtagtagtgtgacaggcattggcgaactatggcttgtgggccagattaagcctatgactagtttttctacagcctgtcacctaagaatggtttttacttttttaaatggttgaaaaatagtcaaaagtagaatgttttgggaagcatgaaaatgatttgaagttcaaatttcagtgttcataaataacattttattacagtcaccctcatttgtttacatattgtctgtggcagcttttgtgttatgttagcagagttgagtagtttcagcaaagaccaaatggtctgcagagactgaaatatgtattgtatggccctttacagaaaaagtttgctgacctctactttatgacattctcaaaagaatggcttaaattcagctttatgtaattgatgtatttctaaaaaggcaataattaaaatatgtgatgaaatcataaaaaaaaan

SEQ ID NO: 46345 - DNA, 257 bp, Homo sapiens
attttgcaaatataaagtgagtgaaatcagctaataatgcaatacaataagacttgtgttaaacagagctttttccccatgaatactttttactctttcctttgaacatctcgatacttaaatacatttccttttattggcttgcagaaattaagcaaaaagtgaactattacctagctacaagatactaaatagtataagagtttggagctgtccagttgtaataaatagaaaataacaaatatagtgaaatatgc

SEQ ID NO: 46346 - DNA, 571 bp, Homo sapiens
atcaaacagcacaagtatttaacccgagtctggctgctcctggccagtccaatccacattttaaaggacagaggcgaggggccaaatctcccctggataagcgcctctgctagagtcacagactggctcggtgatcttagcacttaaactttcaataacccagtttccacatctgtacaatgtggacagaaatatatctatcctgtgggatggtagggaggattaaaccaaacagtgcacatcccaggtggaatgcagtgccaggacacagtgcacactcaggtatggtttgctggatcctcagccgcagcacatgtgttccagacccgtttgctaccacaggtgtacttgtgtcaacggaaaatggaaaggcagaagccacacgcttgaggcacatgagctccacgaagctcagaaactttctctggggacagagggaggtgaatctgctaggtgccccgcctcacgcctcctatcctcacagtaacaaatgcttcaaatagcatcacctgtcagagtgtgttcagtttctagattgtcaggcaaaacctcacttaaaaagagaaaaaaa

SEQ ID NO: 46347 - DNA, 1138 bp, Homo sapiens
aattacagtactggttttcctgccccagtactgatttccgcagaggtttctgctagtatctttttacttcagtgagttataattcttgtgtttgcctgcctgtgtctccaattttcagggcagcagtttgctctgtgaactcacttcactgccaaatctaagagttgttgagtttcagtttgttcagctttttacctgttagtactgacttcaaagccccctgcgtgctggaccagaaactggaagtcaacaataaaaatcaaggtgtgattttcaccaagaaaaattatttaaaagaccagtatttataaatatcttggaggcttttttaaacaacagaatatttaaaatcctaccattggccaggcgtggtggctcacacctgtaatcccagcactttgggaggccgaggtgggcggattgcctgaggtcaggagtttgagactagcctgaccaatatggtgaaaccttgtctcttctaaaaatacagaaattaggtgggtgtggtggcatgtccctgtagtcccagctcaggaggctgaggcaggagaatcgcttgaacctggaaggcggaggttgcagtgagccaagattgtgccactgcactccagcctgggtgacagaaaaaaaaaaaattctgccataaaatcatgagctattctaccacaaactcatgaatggtaaaatattgctaacaagatttgacaagaagacaatccttgacaatataatggacaagaagacattataaaattgagagttggtttctagatgagaagagttaatattataaacattttgaatttcccagaattaatttgattaatactgtagtaagtagatataattgtagtaaatttttcaaagaatgaaaaaagatttcaaaagttaatatggaagaattactagagctttgaattactagttcttaaaatacattatacagtcacatgattaaaacttaggaactatttcagaaatatatagatcagtaaaaaaaagacattccagcatgaagaaaatccaaatacaatgtgatttcatctgataaataagacattttcataccatagagcagtctgctcaattcatgaacagttctgggacatttggttagctatatattaaaaaaaaaaaa

SEQ ID NO: 46348 - DNA, 360 bp, Homo sapiens
aaaaatacaaaaatttaccgggcatagtgatgtgtgcttgtagtcttggctacttggaaggctgaggtgggagaattgcttgggcccaggaggtcaaggctgcagtgagccacgatcatgccactgcactccaacctgggtgacagagccaaaccctatatcaaacaaaccaaaaaaaaaaatggaatttgtgctactgaaagatataaattaatcttctgaatttcaaatagggttgtatgaagggtaataatatataagaccaataattctctgaaaccagttaaatctttctagtatctaatacttgacaagcaaatcagtgaatgcattagatttattccagcaaatttaatgaag

SEQ ID NO: 46349 - DNA, 106 bp, Homo sapiens
ttgaggaacttagctcattcattctatttttctcattataatataaagtggttaaggcaatgatagaactgccctctcttctgccctcgtcttacaacaaaataga

SEQ ID NO: 46350 - DNA, 363 bp, Homo sapiens
atttttaatatttcatagacaggtagttacaagcaaggaagctggagccaggtgggttggaggcacagttctgatgcatagcagctgtgtgccccggatgaattcttaatctagcagggcttcagtgtcctcttcgaaatgggaatcaccgtaagacctccctcatagggtttctatgaagatttaatgagttcgtatttagaaagcatttagagtagcgtctagtacacagtaagtggtacatcgtcatcattaaatacatgaacatttgctttccacttccaatttcatagaattcttaaaggtcattagccaggggataaatgtggatccactcgtgaccacagcagttactggatttaa

SEQ ID NO: 46351 - DNA, 245 bp, Homo sapiens
gactcagtattatataattattatttcttcctgaaatattttagaaatcaaatgcaatctcaattacaatcccaacaagatatatttagaaaatcaataagatgaatagaaagttcgttcatctaaaagaaaaaaacaaaacaaaaagaggtgaggctaggaaaattttgaaaaataagacaagagaaggctaatttttaaaacaacaagcatgtatttcagaaaaacaaaatacagttaattga

SEQ ID NO: 46352 - DNA, 176 bp, Homo sapiens
accccccatgactcaaaggatatggtttgtttttgttgatcttagttcttagggctataaaaatgggttagttccctaacttgagttttcccttttttcaggttttcttacggaaactggaaaaaccagagccagcactattttttctaccggaactgaatctgccttccaagtta

SEQ ID NO: 46353 - DNA, 641 bp, Homo sapiens
cttctggcttttgctctcgcaagaggaagtgttgccaaagtcatgagctctctatgcaccatcactgaccatctggacacgcagtatgatgcctcatccctcatcttgtccatggcgtcagtcagacagaacctgctcctcaaatatggtaaacctctccagttgactcttcaggcatgtgatgtcaaaggaaaagaagataagtctggacccgaaaacctccttgttgaaccgtggacaagggatggttttcttacggaaactggaaaaaccagagccagcactattttttctaccggaactgaatctgccttccaagttacacagataagaattatggttcgacgtggtggcattggtgcccagtgtgggttggtgtttgcctataactcatcttcagataaattttgtgcggaagaacacttcaaaaggtttgaaaaatatgacaaatggaagcttcaggagctcaggcaatttgtaaaaagcaggattggttgctcatctgatgaccttggagaggatgatcctattggctggtttgaactggaagaagaatgggatgaagcagatgtgaagctgcaacagtgcagagttgccaaagtaagcattagtgagttcgtttgcccactccagcctccttt

SEQ ID NO: 46354 - DNA, 385 bp, Homo sapiens
acttttgtaaccacctctgactacttttgtatatcaaagttgattacttttgaaatatttggatctagtttctaagttattttagtgttttatatgttccccaaaattactttgaatctgtcaccagcataatgagttcttggtgatacaatggtgagacttgtaatgagcaaaaagctacctggagtagctcctcttttccttctttcttagtaacctgttttttgattaccgtaagacatcacagattacctgaaaccccttccagtataactaggccctccttccttccacatttaattgcttaatagtttgaagaaactattggaaatgggcattttatatgacatgtatggctttacaatattaaatatgagcaaaaaga

SEQ ID NO: 46355 - DNA, 1467 bp, Homo sapiens
gtgtaggtcaagcagagagagaatcatcattatgtgttgcgcaaatgccacaggtttacacaaacttaatctttgtgttgtggggaaggccaaaaagccccgagcattcaaaggcactgacctttcaaaccttcctgtgacatattacagtcaaaaaggtgcatggatagaacagtctgttttcagacagtggtttgaaaagtactttgtgccacaggtacagaagcatttgaaatccaagggacttttagaaaaagcagtgcttcttttagatttccccccagcacgtccaaatgaagaaatgttgagttcagatgatggcagaataattgtgaagtatttgccaccaaatgtcacaagtctgattcaaccaatgagccagggagttctagccactgtaaaaagatactatcgagcaggacttctccagaaatacatggatgaaggaaatgacccaaaaatattttggaagaacttgacagtgttggatgcaatttatgaagtgtcaagagcttggaacatggtaaaatcaagtaccataaccaaagcatggaaaaaacttttccctggcaatgaagagaattcaggtatgaacattgatgaaggagccattttagcagctaatttagcaacagttttacagaacacagaagaatgtgaacatgttgacattgagaatattgatcagtggttcgactctcggagcagtgactcaagctgtcaggtgctgactgacagtgaaagtgctgaggaccagaccaaggctgctgagcaaaagccttccagtaagagtagaaaaacagaactgaatccagagaagcatattagccataaagcggcacttgaatggactgaaaatttactggattatcttgaacaacaagatgacatgcttctgtctgataaattggtattaaggaggcttcggaccataataagaaaaaaacagaagatccaaaataacaaaaatcattaataaggctcttaagtatttcagtgtatctgcatctttgtgactatctgcagtgaaactttgcttgtttgaagtcctgtggattccaaagccaaatacattttataaatgattttggaattagatgtcagtttggattacttaaattacaactctttaatgttgactctagtcattgggcattgacgtgtaacttgtctttctactgtttctaatatctattaattagatcataaggtacctgaggccagggatcttgtgtctgttgtgcctgaatttggcgtgtctaataaaggcccatgcacactataggcactcaataaaacttacatttttatgatttttctttgaagttgaacttccaaattgaaatatgttgggggtaagtttccatttccgcagcttttccactgctgaaaagaagagttcagcaaaaattgcgcttgaagtatttcactgcgactgcagagaactgaaggaaaatagtttaaagc

SEQ ID NO: 46356 - DNA, 406 bp, Homo sapiens
aacaaagaggaacgacctgcttactctgtagtctggagcagaatgaaatagaacacgtagggcagaacacaacaaatgagttgtaaatgtctgtgcacaaggcttgatcttggggatggagggaggatattttttaagttattcaaacgctgagttgctttcaaagagttcttctcagacatcaacaatgaactcttcagataccctcatcccagacagccctgaagtccagtttataacaagaccaataactcactccttatctctaaagctacttgttcaattctcttgacttcagggccaaaatgagttgtttattacttatggcaagtataaaaaaggccatctcaacctgtggtcagttccacgaatggcaacttgttttctgataacttgcatgcacatg

SEQ ID NO: 46357 - DNA, 388 bp, Homo sapiens
agtcactgggcaagatttggaagtattcttggtttgcatagggttttaatttttgttttggtggttttattttttgtttttgtttgtttctaatactataatttctttgttaattttcagtaattagaaattttaaaaagtttctgaatttatgtaaactgagaaaatattctaatgttatcatataacaaagatgaaatatcttccagaaacctgaatttccatctctataaattcctaatgggttgtcatcagcctctgttgatgggaaccttgctacgtattattacttcattcttctgagcagctttagttgtcataaagtgcgtcctcatcttttgctttctcatgttacttttttgtagttttttccacttgaaaacagatc

SEQ ID NO: 46358 - DNA, 356 bp, Homo sapiens
aaagaagggcatttaaggaaaactacaacacatttccccagaaagacctgaatgacgaatatgaggttttcagctcaaaatcaggtctcatgacttcattattggatttgcacctaacatagatcataatttttgtatcttatgagaggaacaaatatcaaaatatgatacagctttaggtatatgttagaggccctttcttggttgtacgggaatgaaggaaaggacactggaacttcttgcccttcttcaatgtatgctacataattattaagccactcctcaccttttgagtacaattgatgaaggatgttgtaaacatagtgctggacaaatcactggtctcaatacatact

SEQ ID NO: 46359 - DNA, 496 bp, Homo sapiens
ttaatgatgcgagtttaggtgggaagcaaaaacaaaaaaaggataagttggtgattaccataaaattcaggatagtggtaacctttaagagggagggagaatattgtgattaagaggggccaggtgtgagatttcaaagttgctggcaagttgtatttatttatttggatggcagttccaggttttacttgcggtggatcattgagctgtgtatacctgtgaagtactggtttatccatacacacagacatgcatatagcacaattatatatgagtatatgtatgtgggtgctcaggacttggaggtgaagtctttatataccatgccagggcaggtaaagcacaagctcagcttttgatctgttttcttctcccaacactcagaacacaactcactcatcctgccaaggagagtaaaaggcttcatcatttccttggatttaccttgaatgttgatcctaagtcaccatagctgtgaggtagggacagtgtcctg

SEQ ID NO: 46360 - DNA, 693 bp, Homo sapiens
  misc_feature (33)..(34): n is a, c, g, or t
ccactcctgatccttacctttgttgcagctgcnncaaaggtaaggatcagaagtagattcatggtggtagagtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 46361 - DNA, 782 bp, Homo sapiens
cttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 46362 - DNA, 716 bp, Homo sapiens
  misc_feature (33)..(34): n is a, c, g, or t
ccactcctgatccttacctttgttgcagctgcnngtgtccttgaattctggctaccacttctgcggtggctccctcatcagcgaacagtgggtggtgtcagcaggtcactgctacaagtcccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 46363 - DNA, 556 bp, Homo sapiens
ctgttcattcccctccaggacttcgatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtgccgactacccagacgagctgcagtgcctggatgctcctgtgctgagccaggctgagtgtgaagcctcctaccctggaaagattaccaacaacatgttctgtgtgggcttcctcgagggaggcaaggattcctgccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 46364 - DNA, 806 bp, Homo sapiens
cgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccaggtgagcagccagaggccttcccagccgaccccgctgcctcccacctgaccctggcttcctttgcctctgggtgggaggaaaccccccttccctgttttcccctcttggggccctgggaccacccgaccctggcctcccctcccgccctgggccttgcactcctggctgtagagggagggctagtgttgtggctccaagtttcctttctgctggatgatcttggggacccctgggggccaccttctctgcctgacttcctctgtccttgcccctccagcctgggcagcacccccgtctgttgagggtgcccccttcctctccccacagccccgcctccacatcctggaccctctgctatgattccaggcgggcctgtggccctccctggcaggaaactccttacaccaggggtggcccaggagcgcagggaacccgcaggctgatgccgacttttcagggaaagctcaggagtgcagggaacccgcaggctgacgcagacttttcagggaaagttgtcagtttgggtttttatgtgaaatccttcactttttggacattggcaatgtgttttgtttgtttaataaagcattattggggttgagcaaaactca

SEQ ID NO: 46365 - DNA, 1920 bp, Homo sapiens
cgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgcccttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtc

SEQ ID NO: 46366 - DNA, 2278 bp, Homo sapiens
cgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgcccttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtcaaaaaaaaaaaaaaaaaaaaaaaaaaaaaaacccggggggtttattgggggggggggaaaaaggggttaagtaaatgtgtgccatgtgtggccaatatagggtgtttcctgtgtgacaccaagtttttgtgttgtcacaaggtggtgaaaatcttggggggatctcccattattggggaagctggatattaaatttgcgaataaagcgcggggttaaacgcggggatatagttaatctgtgggaaaaaaaagaaggaagaaaaaaggagaagaaagaagaagaaagaagagagaagataagaagggggaatagataaaaatttatgaatggagaaaagaagatgtgtggagaagaata

SEQ ID NO: 46367 - DNA, 1322 bp, Homo sapiens
cgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgcccttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtc

SEQ ID NO: 46368 - DNA, 2071 bp, Homo sapiens
aactggcggtggttgtagcccttgagggtccttgagtccttcctgcggctgtgtgaggccttggctggcccctgcagtggggagcggccaggctagctccaggccagttctcggtgtcctggggtaggtgctgtgtgccttgtctgccgggcgctgtgcctgtcacgccggggtctgcaggctgcctccctgcagggccctcggtgcagcctggcaccccataaactctgtccttctgtctcatccccttctaacagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgcccttcctcagttgtccggggcgggggtggggggtgctgcgaggaatggagaaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtc

SEQ ID NO: 46369 - DNA, 1884 bp, Homo sapiens
cgtccccctgaccccagggtctgagtcgccgctgccgccgctgccaccatccgcgaggcaggagagaggaggaggagtgcggcgcggcggccccgggaccaaggagggacccagacatggagctgcgggaagaagcctggtctccggggccgctggattctgaggaccagcagatggccagtcacgagaacccagtggacatcctcatcatggatgatgacgacgtccccagctggcctcccaccaagctgtccccgccccagtctgcgcccccagccggcccgcctccccggccgcggccgcccgccccctacatctgcaacgagtgtggcaagagctttagccactggtccaagctgacgcggcaccagcgcacgcacaccggcgagcggcccaacgcctgcgccgactgcggcaagaccttctcgcagagctcgcacctggtgcagcaccggcgcatccacacgggcgagaagccctacgcctgcttggagtgcggcaagcgcttcagctggagctccaacctcatgcagcaccagcgcatccacacgggcgagaagccctacacctgccccgactgcggccgcagcttcactcagagcaagagcctggccaagcaccggcgctcgcacagcggcctcaagcccttcgtgtgcccgcgctgcggccgcggcttcagccagcccaagagcctcgcgcgtcacctgcggctgcacccggagctgtcggggcctggcgtggcggccaaggtgctggcggctagcgtccggcgggccaaggggcccgaagaggcggtggcggcggacggcgagatcgccatccccgtgggcgatggcgagggcatcatcgtggtgggcgcgccgggcgagggggccgcggccgcggcagccatggcgggcgcgggggcaaaggccgcggggccccggtcgcggcgcgccccggcccccaagccgtacgtgtgtctggagtgcgggaagggcttcgggcacggggccgggctcctggcgcaccagcgggcccagcacggggacgggctcggggcggcggggggcgaggagccggcccacatctgcgtggagtgcggggagggcttcgtgcagggcgccgcgctccggagacacaagaagatccacgcggtgggcgcgccctcggtctgcagcagctgcggacagagctactaccgcgcgggcggggaggaggaggacgacgacgacgaggccgcgggcgggcggtgccccgagtgccgcgctggggagggccggtaggggaggggcccgggggggggcgggcagggcccctcgggcttggcgggagcgacgacgtgcaagaccaagagacccagggagaagcggacggggtgcgatggaccccgcggcatccccggctccccgccctcctctgtccctgcgccgtccgtgggggggcactggggcgtattagggcccgttcacttctccgcctcgagactctgccccctcagcctggcccgcccttcctaagttatcggcctgcgagccggagagacaatggagagaactgcagaggccgagtggcgaccaggccccaagcggaaggccattttccctgcccttcctcagttgtccggggcgggggtggggggtgctgcgaggaatggagaaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagcgccgcaggaggcgggtgcccgtttgtcccaggcctgggcgtggtggaggaaggggtgctggaacaataaacggcactatccaaatgtc

SEQ ID NO: 46370 - DNA, 493 bp, Homo sapiens
aacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgagtgccaggtctcccgcgcccgcggtcccaccgccgcccaccgccccgctcagatcccggccttcttcgtccaggtgatggtctggttcccgggaggcgccttcatcgtgggcgctgcttcttcgtacgagggctctgacttggccgcccgcgagaaagtggtgctggtgtttctgcagcacaggctcggcatcttcggcttcctgaggtggcggggccggtaccctttgggaccgcagctgtggccagagcggcggggactgggtgggaagggaggggcggggcctggggcggggatgggggggg

SEQ ID NO: 46371 - DNA, 878 bp, Homo sapiens
aacgatctccccgcggccgccgccgctacctggtgcccgcaggtgcctgcaggagtcctggggccagctggcctcgatgtacgtcagcacgcgggaacggtacaagtggctgcgcttcagcgaggactgtctgtacctgaacgtgtacgcgccggcgcgcgcgcccggggatccccagctgccagtgatggtctggttcccgggaggcgccttcatcgtgggcgctgcttcttcgtacgagggctctgacttggccgcccgcgagaaagtggtgctggtgtttctgcagcacaggctcggcatcttcggcttcctgagcacggacgacagccacgcgcgcgggaactgggggctgctggaccagatggcggctctgcgctgggtgcaggagaacatcgcagccttcgggggagacccaggaaatgtgaccctgttcggccagtcggcgggggccatgagcatctcaggactgatgatgtcacccctagcctcgggtctcttccatcgggccatttcccagagtggcaccgcgttattcagacttttcatcactagtaacccactgaaagtggccaagaaggttgcccacctggctggatgcaaccacaacagcacacagatcctggtaaactgcctgagggcactatcagggaccaaggtgatgcgtgtgtccaacaagatgagattcctccaactgaacttccagagagacccggaagagattatctggtccatgagccctgtggtggatggtgtggtgatcccagatgaccctttggtgctcctgacccaggggaaggtttcatctgtgccctaccttctaggtgtcaacaacctggaattcaattggctcttgccttatgtaagtgagtaggagt

SEQ ID NO: 46372 - DNA, 439 bp, Homo sapiens
atggtcgtcctgtccctgtacctggcagccttcgcactgcgcctcctcctggctgggcttgcccccatgcactgccgggacgcctcccaagcggctgcctgccactatttcaccatggctgaatgaagcgagtggcacaccgaggatccccagttcttggctgaggtgctcttcactgccaccagcatgctcagcttcacccgcctggcctacattctgccggcccacgagtcgctgggcactctgcagatttccattggcaagatgattgaagacatgatccggtgcgtaccggccctgctctgagctcgctcctctctgtagactccacttgacttccttccaaaactccccagctcttgggtaacacaggaatccttgacctgtgttcctacagagacgtgcgctccaaagacctctgaccccctgaaactacagg

SEQ ID NO: 46373 - DNA, 1333 bp, Homo sapiens
atggtcgtcctgtccctgtacctggcagccttcgcactgcgcctcctcctggctgggcttgcccccatgcactgccgggacgcctcccaagcggctgcctgccactatttcaccatggctgaatgaagcgagtggcacaccgaggatccccagttcttggctgaggtgctcttcactgccaccagcatgctcagcttcacccgcctggcctacattctgccggcccacgagtcgctgggcactctgcagatttccattggcaagatgattgaagacatgatccgtttcaatgagacgtttcagtttctgttctggaccatgttcggtatggaagagcacagcgtggtggacgtgcctcagtttctggtgcccgagtttgcaggccgggccctctatggcatctttaccatcatcatggtcattgtgctgctcaacatgctcattgctatgatcaccaactccttccagaagattgaggatgatgctgacgtggagtggacgtttgctcgctccaagctgtatctgttctacttctgagagggcctgacactgcctgtgcccttcaacatcctgccctcctcgaaggctgtcttctaccttctcaggagaatttgccagttcatttgctgttgctgttcctgctgcaaaaccaagaagccagactatcccccgatccctacttttgccaatcccagggcaggggctgtgcctggggagggagagcgtggatcctaccgccttcacgtcatcaaggccctggtacagcgctacacagagactgcccggcgagaattcgaggagacccggcggaaagatctgggcaacagactcacagagctgaccaagaccatatctcgactgcaaagcgaggtagccggtgtgcggtgaactctggcagagggagggacgccccggcctcccgacggtgccagcgtcctcagtcactacatcactcaagtgcacaacagcttccagaacctggggcctcccatccctgagaccccagagctgacagggcctgggattgtgaggacccaggaatcatcaggaaccgggcttcaggacactggaggggtgaggactctggcttccggagagtctggcccctgctccccagctcatgtgctagttcatagggagcaggaagcagagggggctggggacctgccccagggggaggattcggggactgagaggaggtcctgatacagtggaagagtcccttcttctgttgctgagcgtggtagcctaggagggtgagggtggggggccccttgggaggagcctgtgctgcttttcttgcttcaataaagtttctgctctggaaaaaaaa

SEQ ID NO: 46374 - DNA, 1185 bp, Homo sapiens
aagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaattccaaaaacacatggcaatgataatgtctctgcttcttttgagaaattaacttggttctgaaagatggtgtttgcttttcacacctgtatcattaatacttccttgccaaacctaactaggatcctcaccaccactgttagagaaaactgatgctcagttgaaccagaatgttaaatgtgaacaggatttgtctgtgttgttgcccagctatgtttatccatacacattacctggaggaagagaaatctgagataattgagttgattagattacttacatgaagatggtttaattgtatcaatacagaaaaatgcacaaggaaagaaactgacaccttaaggcaacaggacgaggctccatctcagggaaaaaaaaaaagaaaaagctgagcatggcggcatgtgcctgtagtcttagctactcaggaggctgaggcaggaggatcacttgagcccaggagtcgaaggttgcagtggtgccattgtgttccagcctgggtaagagtaaggccctgtttcagtaaaaagaagggagtaaccaagacaggtagggattcagtataataaaagtcaaaagtagttgtttattactagagcctggcactgtaacctggtatgtccaaatgtgatttaatttgctctcaagatgtgcaccagaagaaataacccgaggcatttcaaagaaaaaacaaaatgtgacctgctagttctgttactctgccacaagttaacacattttgaacttaagtgcagagtcccatacatccagtgtgactcccctaatctcaaaaatttagg

SEQ ID NO: 46375 - DNA, 805 bp, Homo sapiens
gtcgctctagaggatccttcgctatcatcggcaccttgagaaatttaactggcagaataaatggaaagaagtcagtaaaaagggagcagttgaacaagcatggtgtctcacaccaataaccccagcactttgggaggccgaggcaggtgaatcacttgaggtcagaagttcaagaccaacctggccaacatggtgaaaacccatctctactaaaaatgcaaaaattagctgggcttggtggcaggtgcttgtgatcccagctactcaggaggctgaggcaggagagtcacttaaaacccaggaggcagaggcagtgagctgagatcgtgccactgtaccccatcctgggcaacaggacgaggctccatctcagggaaaaaaaaaaagaaaaagctgagcatggcggcatgtgcctgtagtcttagctactcaggaggctgaggcaggaggatcacttgagcccaggagtcgaaggttgcagtggtgccattgtgttccagcctgggtaagagtaaggccctgtttcagtaaaaagaagggagtaaccaagacaggtagggattcagtataataaaagtcaaaagtagttgtttattactagagcctggcactgtaacctggtatgtccaaatgtgatttaatttgctctcaagatgtgcaccagaagaaataacccgaggcatttcaaagaaaaaacaaaatgtgacctgctagttctgttactctgccacaagttaacacattttgaacttaagtgcagagtcccatacatccagtgtgactcccctaatctcaaaaatttagg

SEQ ID NO: 46376 - DNA, 1632 bp, Homo sapiens
aagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaattccaaaaacacatggcaatgataatgtctctgcttcttttgagaaattaacttggttctgaaagatggtgtttgcttttcacacctgtatcattaatacttccttgccaaacctaactaggatcctcaccaccactgttagagaaaactgatgctcagttgaaccagaatgttaaatgtgaacaggatttgtctgtgttgttgcccagctatgtttatccatacacattacctggaggaagagaaatctgagataattgagttgattagattacttacatgaagatggtttaattgtatcaatacagaaaaatgcacaaggaaagaaactgacaccttaaggcaacaaagccctccataaaaagtaaccgaattttgagagttacgaactaatgtccattacctgaagtccttctcattccattacccagtaacataaatcaaattcagtaaataagctgctttatgtcttgagcttgagaaatttaactggcagaataaatggaaagaagtcagtaaaaagggagcagttgaacaagcatggtgtctcacaccaataaccccagcactttgggaggccgaggcaggtgaatcacttgaggtcagaagttcaagaccaacctggccaacatggtgaaaacccatctctactaaaaatgcaaaaattagctgggcttggtggcaggtgcttgtgatcccagctactcaggaggctgaggcaggagagtcacttaaaacccaggaggcagaggcagtgagctgagatcgtgccactgtaccccatcctgggcaacaggacgaggctccatctcagggaaaaaaaaaaagaaaaagctgagcatggcggcatgtgcctgtagtcttagctactcaggaggctgaggcaggaggatcacttgagcccaggagtcgaaggttgcagtggtgccattgtgttccagcctgggtaagagtaaggccctgtttcagtaaaaagaagggagtaaccaagacaggtagggattcagtataataaaagtcaaaagtagttgtttattactagagcctggcactgtaacctggtatgtccaaatgtgatttaatttgctctcaagatgtgcaccagaagaaataacccgaggcatttcaaagaaaaaacaaaatgtgacctgctagttctgttactctgccacaagttaacacattttgaacttaagtgcagagtcccatacatccagtgtgactcccctaatctcaaaaatttagg

SEQ ID NO: 46377 - DNA, 1187 bp, Homo sapiens
aagaagtaggtacttaaacttttaagaagtttggctctgaaaaaggcaagaaataatgggttagagagggcaggattgtaaggatttaagataggagaagaggcataagcatatttaaatttccctacttaagggccaaaatcatactgtacctcagtctgaactttttaaaggaattcaaggacacaaaattctgccctgccctgaaatccagtcaggaggaagggagaagagctctgaagtacttttgtaattttcttctacataataattgatttttgtttgattatttttctttcctatagctcctgtttgccaggtttttcatagctgcctatttaaccaaacttgtactcccaagaatagtgcatatttatgattcttaattccaaaaacacatggcaatgataatgtctctgcttcttttgagaaattaacttggttctgaaagatggtgtttgcttttcacacctgtatcattaatacttccttgccaaacctaactaggatcctcaccaccactgttagagaaaactgatgctcagttgaaccagaatgttaaatgtgaacaggatttgtctgtgttgttgcccagctatgtttatccatacacattacctggaggaagagaaatctgagataattgagttgattagattacttacatgaagatggtttaattgtatcaatacagaaaaatgcacaaggaaagaaatgtaccccatcctgggcaacaggacgaggctccatctcagggaaaaaaaaaaagaaaaagctgagcatggcggcatgtgcctgtagtcttagctactcaggaggctgaggcaggaggatcacttgagcccaggagtcgaaggttgcagtggtgccattgtgttccagcctgggtaagagtaaggccctgtttcagtaaaaagaagggagtaaccaagacaggtagggattcagtataataaaagtcaaaagtagttgtttattactagagcctggcactgtaacctggtatgtccaaatgtgatttaatttgctctcaagatgtgcaccagaagaaataacccgaggcatttcaaagaaaaaacaaaatgtgacctgctagttctgttactctgccacaagttaacacattttgaacttaagtgcagagtcccatacatccagtgtgactcccctaatctcaaaaatttagg

SEQ ID NO: 46378 - DNA, 366 bp, Homo sapiens
ggtgagcccaccggctccacgttcttcaccacttgacgagcatgtgtccacacctggcagtcacagcgtggggacgggacccactgcaggcacagggagaggcaggggtgttcctcccacagccagcccactgcttcctagaggctctcagcccaggcttccaggggctccccacagccacccatctgcaccggccctacatgcccagagtccgtgttgaaggactcctggctccacagcgtcacgccttggcacaggcttgcccgctttctccactaccttccatccatacctgtccgtgagcgagctccctgcgccctcaaacatacctctcaagggtcaccacctgtggaaagctttcttcca

SEQ ID NO: 46379 - DNA, 2376 bp, Homo sapiens
  misc_feature (1436)..(1436): n is a, c, g, or t
aaaaaaaattaatatttctgatattatttagagagatagattctgtgctctacaaagattactttttagaataaataggtcagttacttaaacatatccctaaaattggttctttggcttgtatattttgaagtcagtggcttcttgttcctggtttttagctgacattcttttggcatgctttactagttgaatagttcctcaataaatacttgctgctgtacaacatggaaaaagataggggcagttctagagataaaggatacaagtatttgtgttccaatccatgcaggtaaaaatgactaaaccagaaatgtaaatgaggcaggccaaaccaaagattacaagattaaagaacaagggctgaaattcaggcccagcgcggcggctcacgcctgtaattccagcactctgggaggccgaggcaggcagatcacctgaggtcaggagtttgagagcagcctggccaacatggcgcaaccccatctctactaaaaatacaaaaaaattagctgggcgtggtggcacgcgcctgtagtcccagctacttgggaggctgaggcaggagaatagcttgaacccaggaagcggaggttgcagtgagccgaggtcatgccactgcactccagcatgggcaatagagcgagactctgtccccccggaaaaaaagaacaagggctaaattcaaatcaaattttccctgtaccctaagaaaaataattaggccgggagatgtttgactaagtgagtaggcattgttctgtgacggtctgagccccagacctttcctctggatgaatgctgtcccaggtaatgaaatgacttcacttattaatatataggtacacagagttcaggtagatgtggaatgaatggggactcgccccgtctgcccttgaatgtatttagtggtttatgtgaaatgtacctttcaaagttgtctgtatgtttcatactctgggggtgggaatataaatcattgcagcctttttgtagggcactttggcagtactcatcaaaatatgcgatgtgcagatgcttagccagcaactccgcttctatgaatctagccaacagaaatacttgtagaagtgtgcagctataaatgtccacagaggctcagagcctcattgtttttaatagtgaacagttggaaaccaaatagatgtctgtcagtagggatgtggcagaattgtggcatgtttatatgggtatagaaagtatggaggaacatagacccaactgttggtaagagttatctctggatgcaggaataggtaggggttgatgggtacagggtctctactttgcataattttggggccactgttcacatagaacatttgcgatggagtggtgctcctcgattcgtttaatggagagggtttggatgtgcttttgctttttatttaacacatgggtatattacttttctntttctgcaaagagcacttattaattttatagttttttaaattggctttgcccgcttcagtagtcacaggtagctacctgaccgagaagccgacttgggaattactgttactcgtgggtgatactgtcataaaggggttgaaagtacttgttagctgtatatgtcagaattgattaaagagaaccaactattcttgtgcaagggatggtattgtagttaattatgacatttggagaaactaatttctgtctgtcgacactatctctgttccatttagacttagagacttacatgggcaatgcttgactttttgcattcagcacagaaagttaagtaatccactgtggtaaaatattaactaaatttatatgacttcttgactgctgtaagtagagaatatttatcatataagcaccattttcctgaattttttgttactacatattttatcttactgtcactattgtgtaaaatctttgaaaggaaaatgaatactgtgtaatagttaaacccattcataggttgcaatagagtgtcagccaaatgtgtcatacatcaaatcttcagcagcttttgcataatccaggagaattgaataatagttgaagttaattttgccagtgaaatgtagggaaagaaaaatgtttgaaatttaaattattcagatagctaaattcttaatcctaaaatttaaaccccttaattctgtctgtagtgttatatcaagactttttgatagtcatgaaactgagtaaaactttattcagattacttaaaaacagcttttcctgtggttaataacacctttattttgaacagagtactcttaagcaacttatattgtgctgattaaagatttaatctgtgcatattttttaccctgttgtttatttagttttgataactgtgaaataaaccataattaaatcacaaaaaaaaaa

SEQ ID NO: 46380 - DNA, 2257 bp, Homo sapiens
  misc_feature (1317)..(1317): n is a, c, g, or t
aaaaaaaattaatatttctgatattatttagagagatagattctgtgctctacaaagattactttttagaataaataggtcagttacttaaacatatccctaaaattggttctttggcttgtatattttgaagtcagtggcttcttgttcctggtttttagctgacattcttttggcatgctttactagttgaatagttcctcaataaatacttgctgctgtacaacatggaaaaagataggggcagttctagagataaaggatacaagtatttgtgttccaatccatgcaggtaaaaatgactaaaccagaaatgtaaatgaggcaggccaaaccaaagattacaagattaaagaacaagggctgaaattcaggcccagcgcggcggctcacgcctgtaattccagcactctgggaggccgaggcaggcagatcacctgaggcaggagaatagcttgaacccaggaagcggaggttgcagtgagccgaggtcatgccactgcactccagcatgggcaatagagcgagactctgtccccccggaaaaaaagaacaagggctaaattcaaatcaaattttccctgtaccctaagaaaaataattaggccgggagatgtttgactaagtgagtaggcattgttctgtgacggtctgagccccagacctttcctctggatgaatgctgtcccaggtaatgaaatgacttcacttattaatatataggtacacagagttcaggtagatgtggaatgaatggggactcgccccgtctgcccttgaatgtatttagtggtttatgtgaaatgtacctttcaaagttgtctgtatgtttcatactctgggggtgggaatataaatcattgcagcctttttgtagggcactttggcagtactcatcaaaatatgcgatgtgcagatgcttagccagcaactccgcttctatgaatctagccaacagaaatacttgtagaagtgtgcagctataaatgtccacagaggctcagagcctcattgtttttaatagtgaacagttggaaaccaaatagatgtctgtcagtagggatgtggcagaattgtggcatgtttatatgggtatagaaagtatggaggaacatagacccaactgttggtaagagttatctctggatgcaggaataggtaggggttgatgggtacagggtctctactttgcataattttggggccactgttcacatagaacatttgcgatggagtggtgctcctcgattcgtttaatggagagggtttggatgtgcttttgctttttatttaacacatgggtatattacttttctntttctgcaaagagcacttattaattttatagttttttaaattggctttgcccgcttcagtagtcacaggtagctacctgaccgagaagccgacttgggaattactgttactcgtgggtgatactgtcataaaggggttgaaagtacttgttagctgtatatgtcagaattgattaaagagaaccaactattcttgtgcaagggatggtattgtagttaattatgacatttggagaaactaatttctgtctgtcgacactatctctgttccatttagacttagagacttacatgggcaatgcttgactttttgcattcagcacagaaagttaagtaatccactgtggtaaaatattaactaaatttatatgacttcttgactgctgtaagtagagaatatttatcatataagcaccattttcctgaattttttgttactacatattttatcttactgtcactattgtgtaaaatctttgaaaggaaaatgaatactgtgtaatagttaaacccattcataggttgcaatagagtgtcagccaaatgtgtcatacatcaaatcttcagcagcttttgcataatccaggagaattgaataatagttgaagttaattttgccagtgaaatgtagggaaagaaaaatgtttgaaatttaaattattcagatagctaaattcttaatcctaaaatttaaaccccttaattctgtctgtagtgttatatcaagactttttgatagtcatgaaactgagtaaaactttattcagattacttaaaaacagcttttcctgtggttaataacacctttattttgaacagagtactcttaagcaacttatattgtgctgattaaagatttaatctgtgcatattttttaccctgttgtttatttagttttgataactgtgaaataaaccataattaaatcacaaaaaaaaaa

SEQ ID NO: 46381 - DNA, 1042 bp, Homo sapiens
cttggcacagaatatgctgcaaagggagaagaaggaagacgtgtggtatggaatcacctatggataaggttgagaaccatgggctagatgctatggagaccaacgtatcacttactaggctttactttgtgccaggcactggattcggcattaccccatttaagcctcactaccatccttcatgttactattccacgttgccgctcaggagaaacaaaatttttttattaaattcaagtaacctgaggtcccatatttagtaagaggcagaggagttagatgtgtcaatagctaaattacatggctgtgtcctctagctggccagggactgacaacatcagtatcacctggtgactctcccaggggagatgtttttaaaaatcttttccagtaattctgtgcaacatggcaatctgaaaccagtctttcagacctggaagttctttagagaccacaggactctctttgatattttttcttttgaatttttttaaaatacagaatcctttttcatgttctctgtttataaaacaactgcatgtcaattacattattttttagaagataggtacaagagccaggcgtggtggctcatggctgtaatcacaacactttgggaggtcgaggcaggtggatcatttgaggctggaagttcgagaccagcctggccaacatggcaaaacctgtctctactaaaaatataaaaaattagcctggagtagtggtgcatgtcccagctactcgggaggctgaggcatgaaaatcgcttgaacccgggaggtgcaggttgcagtgagccaagatcgcaccactgcactccagcctgggcaacagagcaagactgtgtcttgacagcaacaaaaaaagaagataggtataggaattaaaaagaaagcaaataattactggtagcctgaccactaagagatatatactgatattttttttgcggggggtgcatctccttgcaggcctttttgtatgtttatgttcaaacacatttgtaacaacaatgaataaaaaacgcataatattcaatgac

SEQ ID NO: 46382 - DNA, 342 bp, Homo sapiens
accaatactaagtaatgaggatgagttagtaaacaatgtgaaggtttctccgaactctaaaattaaagtaaaatatgatccagcaattccactactggatatttatccaaaggaaaggaaatcagcatatcaaagggatacctgcacctccatgtctattgcagcactattaacaatagccaaaatatggaatcaacctaagtatccattaatggatgaagggataaagaaaatgtggtatatatatacaatggtaaaccgttaagccattaaaagtcttttgcagcaacatggtggaaattgaaggttattatgttaagtgaaataagccaagagcagaaa

SEQ ID NO: 46383 - DNA, 1966 bp, Homo sapiens
agctgtctgaagtggttatgtatttattgtgtcattgttttttaagggaaaaaaagagttatcactaaatctctttaaaaataaattactttagcatctgctgacagtctgccagtgtttgcacctatgtattgcaaagacaggaatacctcccagtgccctagaaattgtaggtgaaatcttctgtctgcgtcttgaagctctcagctgtgtgtttgttttgttctttttctaggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaactgtatgcaatgga

SEQ ID NO: 46384 - DNA, 2041 bp, Homo sapiens
agcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaactgtatgcaatgga

SEQ ID NO: 46385 - DNA, 1343 bp, Homo sapiens
agcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacaccacagtacgggggatcctctagagt

SEQ ID NO: 46386 - DNA, 814 bp, Homo sapiens
agcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataactcctgagggggggtatccaggtctaagtccgtcgagc

SEQ ID NO: 46387 - DNA, 2167 bp, Homo sapiens
  misc_feature (2054)..(2054): n is a, c, g, or t
  misc_feature (2057)..(2057): n is a, c, g, or t
agcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccgagctgttttgtgtgtaatgaagtggttctttgattaaggagctctatttcttatttaactgatatcccactgccccactccacaaaataggaaaatgaagaaatctttctctctgacttgtttacatcatttcacggaaacacatctttgtttgtaatgcagtattctttctctgtgtttgacagagatggggaggggcagaggaatttaagaggttttaaaagaaatgttatgtttcttatgacttgtttccactcctcgtacaatgctattcttaggtttctacgaaacctaatgttagaaccgcatcctttcagctaagggagggttggatttattttccttgttttagagactacaaatttttaaatatcccattttgactgagaatattgacatataagggaagaagttttctaaattgtgaaagtctggttcttaattaaagaattttttttttaatatcacggttaaaagctgctgccagttagccaagacattatccaccaaattgctttgtgatttatacagggattaatcaaatctggctactataacatggggcattgtaactttaaagtagtgttttaattacagtgatgtattttagactcacattttgtgattcaaatatgttataaaggcattcttgcaccatggtaaagaatgtgtgtggtaaatctccgtttatatgtagttggaaaaaattcactgaataatgttttaatgatagggtattatgatacaatgtaaaaaacaattggttcttcagcagtacagaaagtaaactatatatgtgctatcaggaaaccccttcatactgtgtataaaattgcaatctagtgaaataaactgtatgcaatggaaaaaaaaaaaaanaanctgggttccccacttaatggcttggagacattcccctttcgcagcttggcgataacgagccccaccttggccttgctttcccaccttattggaatggttttagcgttttt

SEQ ID NO: 46388 - DNA, 1408 bp, Homo sapiens
  misc_feature (1197)..(1197): n is a, c, g, or t
agcgcccctgtgggtcctgtggctggagggatcatgggatgcatcatggtcttggtcctggcggtgtatgcctaccgccaccagattcatcgccggagccatcagcatatgtctcctcttgctgcccaagaaatgtcagtgcgtatgtccaacctggagaatgacagagatgaaagggacgacgacagccacgaagacagaggcatcatcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaacaatctcctcacctccacgccaagatgagatctgggagctacagaatgttctggaaagaaaaagaaccggcttaaaacccacagcaagagacctcccttgtgtttgtgctttgtgcagagttgtttgagtcatttcctgcctgtcgacatggttaaaaacgagagaaacaacaacacagtcacatttgtgaagatgtgaggctggttctgaaatggaggggaaataagcctgatgaacagacctgccataacactaatggaaggtaacagaaggcgaacctccaaacacagagacggaacctgcaagtgaagctgagccagaggaatgttccaaagagccagaagcattcagctctccttaactggaagagagaaaaatctgctcacccagagactggaatgtggcacatgcagatacaaatgtgtgcattgaagatttcgctttgtttcttagcggtacctggataccacagttgctgtatggaactcatgttatgctctaaacgatgcatctcagaatttctaagtaaaggattatttttctactatttattgaactttcaaacattctcaaactttggggaaaaggaaaggaaacacaggagaagttttcagcagttgccccggaagtataaagcgttgagctcnacgctttatacttcatctttatattctactttcttttttaggcctgaatgtatctttattctcatgttataggacaatattaaggcattttaaaggtcatcatcctttcatctattttagatacacctactaaatgtttaatatatacttttggagaagtataaagcgttgaggtgcgtagcgacggcccggggaagtataaagcgttgag

SEQ ID NO: 46389 - DNA, 850 bp, Homo sapiens
atgtggttcagagatgaaatacttcccaaactgtgatcttaaaataagaacaacaatagaaaaacaataaaactctccatttgtactttgttgggctaaacacgggaacaataatacagtctgtctcctcttatgttctttaagagatgtttgaaaatcttgtgacacttgagtaaggtcaagcagagaagctttctttgttagagtgagtcactataaatgatctctttgttctctcagtttgccagggataaagcaatataaggtaccaactttttctctgtttttctgttaagaacaataaaaaataatctcagaatgaaatcttcaaaaataacttctcttttttatgttttatagagccagcttataaactacccctgctctaaacaggctatcctatccagcaaggtcactcaatcctgtgaacagccagtgccattccaaggggaaggcatattaactcagaaaatgctgacacacctgacctttcatccctgccactcagcagttctacagaagaccaatttgtatgcaaacaattcacttacaagccagaattcctacaagcataatacagtttttctttaaactcttagtgatagaatatgtatttatgaattccttgggaagggttgcaaactcgaatgaccacaagggccagccagggatggagtgggaactgtgggcaggaggagatgctttgtagagtccagaggtggcagtgactgttcagcaccagaaacattgccatatgggaactcagacttcaggtagttgggtctcctgcattttgagagaagctagaaatgtcttggtatttaaatgttcacaactaacataggaattt

SEQ ID NO: 46390 - DNA, 635 bp, Homo sapiens
tcagctccaacattatggttgctcagtttcttcagaaagcaactcatggagaagtacaaaccacagttagaaagttgagagatttcaatgagaagcacaggacctttaagtcacatggttaccttcagaatgcactcaccaattgagccagcttataaactacccctgctctaaacaggctatcctatccagcaaggtcactcaatcctgtgaacagccagtgccattccaaggggaaggcatattaactcagaaaatgctgacacacctgacctttcatccctgccactcagcagttctacagaagaccaatttgtatgcaaacaattcacttacaagccagaattcctacaagcataatacagtttttctttaaactcttagtgatagaatatgtatttatgaattccttgggaagggttgcaaactcgaatgaccacaagggccagccagggatggagtgggaactgtgggcaggaggagatgctttgtagagtccagaggtggcagtgactgttcagcaccagaaacattgccatatgggaactcagacttcaggtagttgggtctcctgcattttgagagaagctagaaatgtcttggtatttaaatgttcacaactaacataggaattt

SEQ ID NO: 46391 - DNA, 455 bp, Homo sapiens
tcagctccaacattatggttgctcagtttcttcagaaagcaactcatggagaagtacaaaccacagttagaaagttgagagatttcaatgagaagcacaggacctttaagtcacatggttaccttcagaatgcactcaccaattggtacagttatgaaacctctagaagtcatccattcttgtatagacttactctcctggcatgtctacttgctatgaaacagctgtttagtcatgttgccaagaagaaaagaagacagaatgcctctagataaagaaatgctattcctatgtcaacttgctatgcaaagtgtggactgtggaccagcagcatgtgtgtcgcctggcagcttgttgcaaatgcagaatctgaagctctcatctagacctactaaacagacttcactttaacaatataaccgggcaagtcatatagtcattaaaatttgagaagt

SEQ ID NO: 46392 - DNA, 1815 bp, Homo sapiens
atagggaccaaattagatgttgctggtaatatgttaccagtaaatattttgagttgatggtgaatattattgtactgaaagaacaatgagggatagatgtgtggttccaagtctagtgttgggcaagttatataactattcagagtctggatttttatcattgttaaagagtggtctgctgaggtcaggagtttgaggtcaggagtttgagcctgaccaacatggtgaaacgctggctaatttttgtatttttttagtaaagacagggtttctccatgttggccaggctggtctcgaaatcctgaccttaggtgatccacctgcctcagcctcccaaagtgctgggattctgtaatcccactgtaatcccagtggctgagccactgcgcccagcctgcttttgacttttacgacatcgacccttctatgatacatcactgaaactaaaacaaatggtggaagaattggtatctcatagaaacatttttagagaaatgaaaaagcagaaaagtcaagacaaattatagtgtatttctgtaaagttacacagaatgtgctagcctctcctgcctccccctccacttcttctgcctctgccactcctgagacagcaagaccaaccctacccttctgcctactcaacagtgaagataatggggatgaaggcctgtatggtgatccagttaatgaatagtaaatatactttctcttccttaggattttcttaatatttttttctaactttacttttagaatattgcttacaatacataaaacaaaaatgcttccagtcaacagcaggctattacattttagggcaaaatttattacagttctcagttacataagtgggagctgaatgatcagaacccatggacacatagtggggaacaacatacactggagcctgtttggtgggggagttggtcaacggggagggagagcatcaggaagagtacctaatggatgctggggttaatacctaggtgatgggttgatctgtgcagcaaaccaccatgacacacatttacctatataacaaacctgcgcatgtacgccagaacttaaaagttgaaggaaaaaaaaatttcattatggcagagttttgactacatgggtggtcggtgcccctaacccctccattgttcaagggtcaagtgcatattaatataatcagaaaaataacagaacgagaattttttaaattattgcatattgaaagtgtactcataggcaattagtatgctaaatatatattacaagttacgagcaaaatagtggttacatcgattgatttttgaatagtggaccagccttgcattgatgtaataaactcccacttggatgtgatatataatactgctgcattcactttgctagctaacaatagaaactaagattagaaggaaagcatatgtttagcttagcatggtggttccaaatctggctaatcaaaatcaactggaggacttgaaaacacaaatttccaaaccctaactctgcagtgagtttggtgtgctgcctaggaacctgcattttaaatatgctttctaataatatttatggagccaagtaagcccagccatctatttataaagtggaatagtacattgagattgttggtttagtgtttaaaacaaaagcaaaatatctttgagaagtctatcaggtttttcttacacacatgatagacatgtaatttagtgcttcctattattccaggatacagaaatgaacaatagtgtctaccacctggatgtacactgtttaataggtgaaatagatacgtaaaagcaattaaaatatgataaatgc

SEQ ID NO: 46393 - DNA, 392 bp, Homo sapiens
atagggaccaaattagatgttgctggtaatatgttaccagtaaatattttgagttgatggtgaatattattgtactgaaagaacaatgagggatagatgtgtggttccaagtctagtgttgggcaagttatataactattcagagtctggatttttatcattgttaaagagtggtctgctgaggtcaggagtttgaggtcaggagtttgagcctgaccaacatggtgaaacgctgtctactaaaaatacaaaattggccgggtatggtggtgcatgcctgtaatcctagctacttgggagggtgaggcaggagaatcgcttgaacctgggaggtggaagttgcactgagttgagatcacaccacctgcattccatcctgggcaacaagagca

SEQ ID NO: 46394 - DNA, 289 bp, Homo sapiens
tggggtcccacaaccaaaccgtctgcatgctccccttaggggttagagcagtggggcaccgaagaagtgagcaactcatcacatgccctacaagggggataagggaatttttcccgtttcaacaccaaaacacagattcgtcagcatcacagtttggggaacgccactggtgggagtgaatctgagcaggaggtgagtatcagacctgtgtcagaagaggtcccaagtttctgaaaggggctcatgatgggacatcactgtcccctgacctgttagaggtcaccacctg

SEQ ID NO: 46395 - DNA, 342 bp, Homo sapiens
tcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgccca

SEQ ID NO: 46396 - DNA, 430 bp, Homo sapiens
atctggaggggaattttctcagatcttagaccagaaaaagctatgttctgctgagcaactgtacatttccatactttgtggttttgtgaagtatggaatgtagagtttctcaactagaatctagttgataggaatacattaagggttggaaactggaagttccatttagatactgaattactgccaggaattactttttttcttttttctttctttctttcttttttgagatagcctcttactctttcacctgggctggagtgcagtggcacgatcttggggtaagccaccatgcctatttgccctcaaggagctcacagtctctgctcatagatacaacagtgaaacttagctgttttctctccaattagctttacaacaaactgagatttattatctctatttagagataaaggaatttcaaattgaa

SEQ ID NO: 46397 - DNA, 944 bp, Homo sapiens
ggcgtgacctgccaaggtcatgccgtaagcatcctcaggagtcctgctgggactccagagccagcaaggacaaacttcctgggggaggtggcatttgacagtgtgggcctctaggggaagagagggcactataggggaagaggacagcattaataaaggctgaagcgggaaaggacaggcaacaacttctcaaagtggctaggggaaggaagaaatacatacagaaccacgatgacagccttcccgcaagagcccatctgagcttctgggaagaaagcctgtgtggcatttacaatctgcaggtctccagcagtggccctctgggtgtgtctggttgctgctcaggatgagaaagccacgggaggtggtgactcagtccccacccagcctccagatagcctccttttaaattcaagatgagctcagagactggggaaatgtcaagaaaaccctcctcccagaacagatgggaacagacccagggaaggcggcctgaggggtaggctatcaggcagaagccataaacctggagaaacgctgcgggctgtggagaagaggcctgggctacaagtttgcctgtcactgctgtggctgtgggcccctgagcaggtccttgtctctctctgggccccctatttttcattcacctgtgaaacagggagaactccactggcttccgacttccaggcctgttggtggagaacaatggtcgggaaagagcctggctgattacacaatgcctcacacagcctgggagagatgagaagatcactcctattactattagaatagccacaggtgctttcctagttatctgaaccccaaccacagggcatgcgggggtgggggggatggggggggaactgggctgtctagttcctacaaagagaaaagtcacccagatgtttttgggaagggaaagttcacatttattaagtgcctac

SEQ ID NO: 46398 - DNA, 358 bp, Homo sapiens
gaagttgtcagcttaaggtgcagacatggccaagtccaagaaccacaccacacacaaccagtcctgaaaatggcacagaaatggtatcaagaaaccccgatcacaaagatacgaatctcttaagggggtggaccccaagttcctgaggaacatgcgctttgccaagaagcacaacaagaagggcctaaagaagatgcaggccaacaatgccaaggccatgagtgcacgtgccgaggctatcaaggccctcgtaaagcccaaggaggttaagcccaagatcccaaagggtgtcagccacaagctcgattgacttgcctacattgcccaccccaagcttgggaagcgtgcttgtgcccat

SEQ ID NO: 46399 - DNA, 314 bp, Homo sapiens
gtgagggctccagaaatagaaaggttgaagtataaagataccagcttcaataattgaataatctttcttggagaaataagccagaaggcaaaaacaattgaataaataccgactcaaccttaaaaatgtcaacacaatgataacatgccatagcaaaatttcctgaaagtcaacaatatcatgggggattaggttaggtttgggctggggagtgggagataccactgtgctaattgtcgtatctttcagaatatgtagttaaggaatactgtttcatttttttgaaattgataaattgagaaggctattatgct

SEQ ID NO: 46400 - DNA, 682 bp, Homo sapiens
ggattcccacccaggtctggccgactgtaaggctgcccaccatgacaccagctgcaatgtttccatcctcgtccactgttgtgggcatattggggcatgtcctcaaatactccagtctctcctaccctgccccctttgaagtcaggggaggctgcgtggcctctgtggccaatgcaaagtgagctgaagtgacgcagtacttcccggcagaagctttttcttgccatggtgagtgaggaagcacgtgctgcaatacaaactccatcagcggggggcgtggtggccacagcaagaaaaaccttcctgctaaccccactggatgcacagcatgggggagaaatgaatatatactgttaagaccgtgggcattcggggctctttgttactgcagcatacgctagccaccctgactgatataatgctgtcatttgccacatgatgtatgtgatctcctgtcccatccctgatcttcccactcagaaaggctcattgccattgctcccgttttacagatgggaagaccgaggctcagaggaaagcactgagttcaaggtcctggagagaggacctggttaacacaggtgcttcctaaaccctggctggtagaacctcactctgcagctatgcctcaaagctgactaaatcaatctgtctgggattagaattgaggcatcagtattaa

SEQ ID NO: 46401 - DNA, 376 bp, Homo sapiens
atagtagctaaatatagcttcccggcacagatatttaaagagctatgttgatgatgttatgtctgaacagagaagaaagggaagaaaataactttttttccccccgtaaagaagagcaaagttacaccaggttttctgtggggctgcagggagccgagcgacggtgaggtgtcaatgttttaattatagaatcaccagatgttcatgctacaactgtcaccagcttggggcttgggatttagatttctgttgccaggcagtcatttctttataattacttctcgtttctatttaaaaataccttctccttggaaagtaaccccagatgagtgtgcgcttctcaccaagctcagaagagctaccagagggaggcatt

SEQ ID NO: 46402 - DNA, 5772 bp, Homo sapiens
cccttcacacccgacccagccttgaattaggattccataggagagctgggggcaggagaatggggtgttccctgctgtccagcttcagacccactctttgagatattggattctgacaagtttccagagctgagaagacagccagatgtcaaggtctgaagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagccgggcgatggggccattgcggtggatgagctacaggataacaagaagctgaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtatttttcttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctgacatc

SEQ ID NO: 46403 - DNA, 1374 bp, Homo sapiens
ggggggtccttggagagcttcagggtcgcccgggcagggttctggctcatcccggagggacgctagggggcgcggcctctcttcgcgatggccaatccgcggccacccctctcctcccacaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtg

SEQ ID NO: 46404 - DNA, 6363 bp, Homo sapiens
ggggggtccttggagagcttcagggtcgcccgggcagggttctggctcatcccggagggacgctagggggcgcggcctctcttcgcgatggccaatccgcggccacccctctcctcccacaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctgaactacaaatcctggccgggcgtggtggttcaggcctgtaatcccagcactttgggaggccaaggtgggcggatcgcttcaggtcaggagtttgagaccagcctgggaaacatggtgaaaccccgctctctactaaaatacaaaaattagccgggcatggtaacgagtgcctgtaatcccagctacttgggaggctaacgcacgagaatcttggggggaaaaaccccaaaactgtaattcctggctgagacctagttatgcttgagcaggcattgggctccaggcctctggccgctccagaagggcacttgactgtaaggatgaaatcctgtctctgagctgcactcagtgtgaagtgccaccacctgcatccccctgtctcagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtatttttcttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctgacatc

SEQ ID NO: 46405 - DNA, 6309 bp, Homo sapiens
ggggggtccttggagagcttcagggtcgcccgggcagggttctggctcatcccggagggacgctagggggcgcggcctctcttcgcgatggccaatccgcggccacccctctcctcccacaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctgaactacaaatcctggccgggcgtggtggttcaggcctgtaatcccagcactttgggaggccaaggtgggcggatcgcttcaggtcaggagtttgagaccagcctgggaaacatggtgaaaccccgctctctactaaaatacaaaaattagccgggcatggtaacgagtgcctgtaatcccagctacttgggaggctaacgcacgagaatcttggggggaaaaaccccaaaactgtaattcctggctgagacctagttatgcttgagcaggcattgggctccaggcctctggccgctccagaagggcacttgactgtaaggatgaaatcctgtctctgagctgcactcagtgtgaagtgccaccacctgcatccccctgtctcagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtatttttcttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcatgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctgacatc

SEQ ID NO: 46406 - DNA, 2785 bp, Homo sapiens
gccgggtgtagcagatcctcgagatccctgagtaccggagatggatcagaagggccaaagaccttttaacctctacagcttacttcttgtccttttcaaactttcaaacaggagtctaggaagttttttgttttcaccttcctgggatctatcatgtggatagccatgttctcatacctcatggtgtggtgggctcaccaggtgagtgaacagcaggaacgaaatcctctaccagcaggtcccaacgacactttccttcaggatcaatctccggtactcagggaatctcgaggatcaagtgaattcgtgcagtttctatgttgtttgtaaaggcttaaaagtagactttttattccagtgaacgcagtgcttctcaagtgtggcttttctgtcatatcctgtagcatggcatagaaggccttggaatcctgcctgattccagctgaacttggcttattagccttatttcctgctttctctgccatgtacccatccctctcacctggtgaaatcctacgcattctgagagccagcttttttcgcctgctctctggcattcaattagtcttcctctgagtacctatagtgtttctgttctgcctggaatactgaactgtaataattgtttactagctttcctctctaaaaggccgagattagggtctatgtcatcctgctcatacttcacctccagcctcttagttcctggcacacagcaagtgtccacattcctggaaatagaaatgctgacatgaacagctctttggaagggcagttcttgtggggaggtaggggtgttaagagttggaatgacagtgagcagcagatctggtgtaggtaacttttagtccaattgtgaaaagaagagcaacatggtccctgtggccaggagcaggagtcttgcttgctcttcctctctgtggccatctcagctgtcggtccccctatcacccttcctcactcaggctgagggggtgtggctgagctccttagaaggcagtctgtttgcacaaagtaggatgtggatagtgcttggatgtgcctcaggtttttcacctactgttgaccgttgccgtttaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctgacatc

SEQ ID NO: 46407 - DNA, 3200 bp, Homo sapiens
taccaaataccgtcaaatgctctgctcactgactttcaaggcggtggaggtaggattggaaggagcaatgactcaacttcacttcttggtactactcttgctcctttgtatgtgaactcctgctagctcagagactctaaacagcattttgtataacacgcaaatgccttatcctcctgtacccatcctcttactccattctcccaaccttgtcagaaacaggggctattttcatttccccaatcatgttctgaatttgggtggtagatttgtttccttaaatttgaatttgtgtatgtgtatttggggtgaggggcagctaaaaaggcagccctcatcactaaagaattaaaagaaatgtaggccttatcaaaatgtagagatttaagagtacatatcacattggggctgggtgtggtgaagtgtgcctgtaattccagcatttaaaaaaaaaaaaaaaggcacacatcaactgatctgagtcatatagaagtcatgaagtatgcagaaaataaaaacaaagctcagactcagaatacttcagttttaacctaagctcttctagttattaatgagtccttgggcaagtaatttaatttccctgaaacttaatttccttgtctgtgaaatggggctaataatttctgttcacttcatagatattttattggtggaaaaatactttgtaaagtataaactactatttaagtgtatgggattattataaacattaaggatattcacatcgtttcttcaatcttgcagcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtatttttcttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctgacatc

SEQ ID NO: 46408 - DNA, 520 bp, Homo sapiens
agagctgagaagacagccagatgtcaaggtctgaaggtaaatgatgtaattaggtaggagggatcagctggggtgccagttcagctctgttacataacacaggaacattagaaagagagagaccctctgaaatttctgctggggatacgagtgggcttgctgcaaagtgttgagttcatggcaaggatcggggggctgcagggagatagtggaaagaaaattatagaaatcagggacaaagaaggaagttcacttattcctacttttccttttgcttgtccctctcttgctttttaagacaagtacctttgcatctctgattagtgtggcatgcaagaaagaaaggggagttaggaggctcatctgcttggctactcactagctgtgtgatgttaagcaagtcacatctcctctctggacctctgtgttttcatatctcagatgaggagttgtaccagacagattccatgggttactcagctcacttctaatatatcatatgcaaaactaatcatttcca

SEQ ID NO: 46409 - DNA, 5608 bp, Homo sapiens
ggggggtccttggagagcttcagggtcgcccgggcagggttctggctcatcccggagggacgctagggggcgcggcctctcttcgcgatggccaatccgcggccacccctctcctcccacaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctgaactacaaatcctggccgggcgtggtggttcaggcctgtaatcccagcactttgggaggccaaggtgggcggatcgcttcaggtcaggagtttgagaccagcctgggaaacatggtgaaaccccgctctctactaaaatacaaaaattagccgggcatggtaacgagtgcctgtaatcccagctacttgggaggctaacgcacgagaatcttggggggaaaaaccccaaaactgtaattcctggctgaggtatgctttgtatatccttcttagctgacctgagcccaatttacctcaagacttggcctcttggtctcctcagcccaaatgctcactttatttcccctatcccctctttgagggaagcagagggccctcgttcctctcaccctggacaaggcatgcgtgctcagatttccctgtaaggcaacatgggctcttgcctgccactctggccacctggtgtctccattgtagtctgtgcctcagtgaggtccttaagagggcaagaggtgactttctttctaaccatgtagggagccagggaatcccagctagagataggcttagatggatgccagcaggcccctgggtagttacggttcaaagaacaatgtggaaccacataggttacaaagtgagtacagaaaggcctctagaaggcctcaggcatttgcctttttcttttagctgataggatggggcgagattaggagatgggacgaggaaggaggatgctttgaactgaacagacaaatctgtctgacttctcacagcttgttatgtgggagattgtggggccagttgcttgtagttttttcctgtccctgggaatatccctgccagcactggggccagggccctgcagactgccctatttgcttcaaaacttctttccccaacctggctgatctcaccatgtcaagacctagttatgcttgagcaggcattgggctccaggcctctggccgctccagaagggcacttgactgtaaggatgaaatcctgtctctgagctgcactcagtgtgaagtgccaccacctgcatccccctgtctcagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggtgagtgaacagcaggaacgaaatcctctaccagcaggtcccaacgacactttccttcaggatcaatctccggtactcagggaatctcgaggatcaagtgaattcgtgcagtttctatgttgtttgtaaaggcttaaaagtagactttttattccagtgaacgcagtgcttctcaagtgtggcttttctgtcatatcctgtagcatggcatagaaggccttggaatcctgcctgattccagctgaacttggcttattagccttatttcctgctttctctgccatgtacccatccctctcacctggtgaaatcctacgcattctgagagccagcttttttcgcctgctctctggcattcaattagtcttcctctgagtacctatagtgtttctgttctgcctggaatactgaactgtaataattgtttactagctttcctctctaaaaggccgagattagggtctatgtcatcctgctcatacttcacctccagcctcttagttcctggcacacagcaagtgtccacattcctggaaatagaaatgctgacatgaacagctctttggaagggcagttcttgtggggaggtaggggtgttaagagttggaatgacagtgagcagcagatctggtgtaggtaacttttagtccaattgtgaaaagaagagcaacatggtccctgtggccaggagcaggagtcttgcttgctcttcctctctgtggccatctcagctgtcggtccccctatcacccttcctcactcaggctgagggggtgtggctgagctccttagaaggcagtctgtttgcacaaagtaggatgtggatagtgcttggatgtgcctcaggtttttcacctactgttgaccgttgccgtttaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtggggtgagtggcaatgtaactttctaaggggtgttaagtatgactggaaaacactgcattggctctgttcactggttttctgctttattcattatacatagaataaaagggcatttatattgtt

SEQ ID NO: 46410 - DNA, 5945 bp, Homo sapiens
ggggggtccttggagagcttcagggtcgcccgggcagggttctggctcatcccggagggacgctagggggcgcggcctctcttcgcgatggccaatccgcggccacccctctcctcccacaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctgaactacaaatcctggccgggcgtggtggttcaggcctgtaatcccagcactttgggaggccaaggtgggcggatcgcttcaggtcaggagtttgagaccagcctgggaaacatggtgaaaccccgctctctactaaaatacaaaaattagccgggcatggtaacgagtgcctgtaatcccagctacttgggaggctaacgcacgagaatcttggggggaaaaaccccaaaactgtaattcctggctgagacctagttatgcttgagcaggcattgggctccaggcctctggccgctccagaagggcacttgactgtaaggatgaaatcctgtctctgagctgcactcagtgtgaagtgccaccacctgcatccccctgtctcagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggcttgcctgttccttggttgcttttctctcttatcaatggattacagccagttccagtcagcagcaatggcttgttttgtgcaattgttttgctttttctcatgcttctgtttgtgatctcttcaattgcgtcatgtaaatggagaatgaacaagatcctgggcttcacaatgttcctcctttactttgtattcctgataatcagtgtgatgttagaagatcgaatcatatcctgtcctgtatctgtctgaatcagtcactcttgctcacaatgggcatggatcagaagaccatgcagaagttactgtatctcttgtgaccctaatgaaagaatgtatatgatcctggaaagtgaactgggtgacctaggacctctgatatgaatgtgatctgagactaaagtttgtccttggaaacacctgcagctcattgtggattaagaacctcacccctggaggggtggagtttctacccctgactcatgcagacatctattacatggaggcagtagaaggacccctggagccagagggttttctaaatgagataactgggggcaaaggttgggataggcgcagcagctataagacaagctcctacgctcactgttccctgatcattccaaaggctgctggcccaaaagatgcagatgtggtctacatctcagccttcctgacctctgccccaaacacacgctgcaattttgtctcctccttttctgttcaaattgtgaggttctatcaggtttgtaatcactgtagcttcagttattggtgagtctaaggatccaaggctacagaaaaaaaagaaatataacaggaattaatgatcattccacgttttgtagcccactgcatctggatatataccagtatttttcttttttttttttttgagacagagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtg

SEQ ID NO: 46411 - DNA, 6345 bp, Homo sapiens
ggggggtccttggagagcttcagggtcgcccgggcagggttctggctcatcccggagggacgctagggggcgcggcctctcttcgcgatggccaatccgcggccacccctctcctcccacaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttcacacttttgtcccctcactcccctgggccccgtcggtgcacgagcccaacccttcctgctattttcctcgtcactctttagccccctctctcgtatcctctgaaccggttgacagaatcctcttcctgttctttttaaactgcaattcctgaactacaaatcctggccgggcgtggtggttcaggcctgtaatcccagcactttgggaggccaaggtgggcggatcgcttcaggtcaggagtttgagaccagcctgggaaacatggtgaaaccccgctctctactaaaatacaaaaattagccgggcatggtaacgagtgcctgtaatcccagctacttgggaggctaacgcacgagaatcttggggggaaaaaccccaaaactgtaattcctggctgagacctagttatgcttgagcaggcattgggctccaggcctctggccgctccagaagggcacttgactgtaaggatgaaatcctgtctctgagctgcactcagtgtgaagtgccaccacctgcatccccctgtctcagggttgtggataccccctggctgggcttcatggagaaatcttctctgatcaccaacctgaatcccagagtagcctccatcttaggacagaatgagaggccttctgtaaccagatataactggccagcatggggaaattgatcaggatggggccgcaagagaggtggttactccggacaaagcggcttcattggagtcgcctcctcttcttactgggaatgttgatcatcggttctacttatcagcaccttaggagaccccggggcctttcctcattgtgggcagcagtctcttctcatcagcctataaaactggccagtcgggacctctccagtgaagagatgatgatgatgagcagcagcccttcaaaacctagctccgaaatggggggtaagatgctggtaccccaagcctcagtgggcagtgatgaagcaacactgagcatgacagtggagaatatccccagtatgcctaaaagaacagccaagatgatcccaacaacaaccaagaataattacagcccaacagcagcaggtacagaaagaaggaaggaagacaccccaacatccagtagaacactgacttactacacctcaacttcaagcagacaaatagtaaaaaagtataccccaacacccaggggagaaatgaagagctacagcccaactcaagtgagggaaaaggtgaagtatactccttccccacgtggtagaagagtaggcacttacgtgccgtccacattcatgacaatggaaacaagccatgcgatcacccccaggacaacagtgaaagacagtgacattacagcaacctataaaatactcgaaaccaactctcttaagagaataatggaggaaaccaccccaaccactctcaagggaatgtttgatagcaccccaacttttctgacacatgaggtagaagcaaacgtcttgacttctccaaggagcgtcatggaaaaaaacaacctgtttccccccagaagagtggaaagtaacagctcagcccatccctgggggttagtgggaaagagcaacccgaagactccccagggaacagtcctgttgcataccccagccacctctgaggggcaggtgacaataagcaccatgacaggcagcagcccagcagaaaccaaagccttcactgctgcctggagtcttaggaatccttcacccaggaccagtgtatcagccatcaaaacagccccagccatagtctggaggctggcaaagaaaccttccacagcacccagcacctcaacaacccctacggtcagggcaaagctgaccatgcaggtccatcactgtgtggttgtgaagccaaccccagccatgctcaccactccctccccaagcctcacaacagccctgctcccagaggagctcagtcctagtccctcagtgctgcctcccagcttgccagacctccaccccaagggagagtaccccccagatctgttcagtgtggaggagcggcggcagggctgggtggtcctgcacgtttttggcatgatgtatgtgtttgtggccttggccattgtttgcgacgagtacttcgttccagccctgggtgtcatcacagacaagctgcagatctccgaggatgtggcaggcgccacattcatggctgctggaggctctgctcctgagctcttcacctccctcatcggtgtcttcatttcccacagcaacgtgggcattggtaccattgtgggctctgctgtgttcaacattctctttgtcattggcacttgttccctcttctcccgagagatcctcaacctcacctggtggcccttattccgtgatgtctccttctacatccttgacctgataatgctcatcctcttcttcctggacagcctcattgcctggtgggagagcctgctgctgctgctggcctatgccttctatgtgttcaccatgaagtggaacaagcatatcgaggtctgggtgaaggagcagctcagcaggaggccagtggccaaggtcatggccttagaagacctcagcaagctcccgtccttgctgacccgagggagcagctcgacctctctgcacaacagcaccatccgcagcaccatctaccagctcatgctccacagcctggaccccctgagggaagttcgccttgccaaggagaaggaggaggagagcttgaatcaaggggccagagcccaaccccaggccaaagcagaaagcaaaccagaagaggaggagccagccaagctccctgcggtcacggtcacaccagcccctgttccagacatcaagggagatcagaaggagaatccaggcggtcaggaagatgtggctgaggccgagagcacaggtgaaatgccaggcgaagagggcgaaactgctggtgaaggtgaaactgaagagaaaagtggaggtgaaactcaaccagaaggtgaaggtgaaactgaaacacaaggaaaaggagaagaatgtgaagatgaaaatgaagcagaaggaaaaggagacaatgaaggtgaagatgagggtgaaatccacgcagaagatggtgaaatgaaaggtaatgaaggtgaaactgaaagccaggaactcagtgctgaaaatcacggtgaagccaaaaatgatgagaaaggtgtagaagatggagggggaagtgatggaggggatagcgaagaggaggaagaggaggaggaagagcaggaggaagaggaggaggaggaagagcaggaggaagaggaggaggaggaggaggaagaggaggagaagggaaatgaagagcctctgtccctggactggcctgaaaccaggcagaagcaggccatttacctcttccttctgcccatcgtgttcccactgtggctgacagtccccgacgtccgaaggcaggagtctaggaagttttttgttttcaccttcctgggatctatcatgtggatagccatgttctcatacctcatggtgtggtgggctcaccaggtgagtgaacagcaggaacgaaatcctctaccagcaggtcccaacgacactttccttcaggatcaatctccggtactcagggaatctcgaggatcaagtgaattcgtgcagtttctatgttgtttgtaaaggcttaaaagtagactttttattccagtgaacgcagtgcttctcaagtgtggcttttctgtcatatcctgtagcatggcatagaaggccttggaatcctgcctgattccagctgaacttggcttattagccttatttcctgctttctctgccatgtacccatccctctcacctggtgaaatcctacgcattctgagagccagcttttttcgcctgctctctggcattcaattagtcttcctctgagtacctatagtgtttctgttctgcctggaatactgaactgtaataattgtttactagctttcctctctaaaaggccgagattagggtctatgtcatcctgctcatacttcacctccagcctcttagttcctggcacacagcaagtgtccacattcctggaaatagaaatgctgacatgaacagctctttggaagggcagttcttgtggggaggtaggggtgttaagagttggaatgacagtgagcagcagatctggtgtaggtaacttttagtccaattgtgaaaagaagagcaacatggtccctgtggccaggagcaggagtcttgcttgctcttcctctctgtggccatctcagctgtcggtccccctatcacccttcctcactcaggctgagggggtgtggctgagctccttagaaggcagtctgtttgcacaaagtaggatgtggatagtgcttggatgtgcctcaggtttttcacctactgttgaccgttgccgtttaccaggttggtgaaacaatagggatttctgaagagatcatgggcctgacaatccttgcagcaggcacatcaattcctgacctcatcaccagtgtgattgtcgctcgaaaaggcctgggagacatggctgtgtcaagctctgtgggcagtaacatatttgatatcactgtgggagtttggctcttgttgcccaggctggtgtgcaatggcgtgatctcggcacaccacaaccttcacctccccggttcaagcaattctcctgcctcagcctgaagtcgtgatctgcccgcctcggcctcccaaagtgctgggattacaggcgtcagccaccgcgcctggcctataccagtattttctagtttaaaggaggactacattaactcttattgttgtgtttctgaaaagtgaaatttaaaaagcagcctgaaaaataaaaatttataatttgcccttgaattggaaggaatggagattagggaaggaaaactactctagaggccatttaaaagtatgtatttattagaacatgcaaattcatgttgtctccatcagtggtcaccttgagggattagacattctaatggaatgtcctggctccaccctccagcatgttctcacccaacaatgacagttgagtggagtgggaagggaagtcattctaaagagtccaaagtcagtagcgccacatctggtttataaagtaagagatccagtgggacaatgctatttttgtatgccaacctagataggattataaagcaagactgatttcttctgtggtttatgaatggatcttaaggtaattacaaaagggaaattccaagaatgcataacacaatgacaacatggtgagaaaagtgcagtactacttccaaggtagctagtgtaaaggacacttgagtttttaaaactgtggttaaatgttttatgtggaatttgatgagtttgtatattaaataccactgcttgctgcttttactagaatcaagttaagggacacgttagaaatagaacagcttaatatcactggcttcagagcaaaatgagctcgggtgactgcagattatgatggtaaatatggctttaattacaaacatgaggaatgattcactgaagatgaaaagataggacggatgtgatatgaaaaaaacccaaacattttggcattgaatgatggctaaggtgttccaagtattccatcttttaagatgaattgcttaattaattgcctcgctaccccaggattctcattctttggaaataatttttattaaatttcaataaactgtgaatcccaatggtattttactttacaacatggatgggctcatccttatctttaggtcatttggtcagaatcctcccgagaagactgatgaagagtatggaatcatgttccaattctatattcttaattatccttattcctgatgctactgcattgctgggtttccatagccaaggcctaagaacaggaggagaaggcaatgcttgtgggagggaggtcccaataccaaaattctgggcactaacctggtgtctgcagcccgttcccgttagcctcggggatgtcacctcacccacagcctgggatctgacgttcttcctcagactggagtaaggagtgatggaccgtaaaatgctgtgtaatgataaaaggctgaaatatccactgaatgattaaaaccaactctaataatctgacatc

SEQ ID NO: 46412 - DNA, 5617 bp, Homo sapiens
  misc_feature (3284)..(3284): n is a, c, g, or t
aagaaaaagaagaagaaaaagaggaagaagaagaaggaggaggaggaggaggaggaggagggggccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgaattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacntgtgggaggaattttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactactattccagttctcctgtgtcagtcttgcctatagattttgccatcgttttctgtcaaagttccttttgcatgaaacaattatgcaaacttataattattagtgctgaaaaagagtttattttccatcttgtttgttttcctaccttatgctgagtagtccagagagttaaaaaaattctctgcatgttggtcttttaagtctgttttgctctaatcctccattaagcgagcatacctcaagtgggtctattagcatttaatgaccttttatgccagttgtgccatcccttaagatgaaaagttccttttcttgtgttaatgtacaaagcttttcttttggcactgacaactgtgttctacctgggaattttgaatagccattttcatggctgtgtgttgtgtaacacaaatgtttttaaatggtattctcacccagtaggccagctctccaaacgttgcttagatgcttcaaaattagcatattttaagtttaccagtataaaataccaatgcaactactctacatagccaaatgtttgtaaatcacgtcttattttcctgaggtttttcactccaccaaatcttacaaatcattgaaagaaatatattctaacagtacgcactgaatagtgaaaataattagacattttaagaaccagagccatagaattattttaaattagtagaaaagaggagctatttccgaatctatagaataaagtaccacctaaaactgaattttatcatataagcaagtaatacctattagtcatacctaaatttttcagcacttcattcaattaaaatacatgaattttaaatattttacatgatgtgaataggcatgataatacttttagtataaaatctaaactttttccatttatcagaaatgataaaatccagttaccacatatcacgtttataaaatccttaattaaatgagtaacttctaaaatataacaatactaaatatcacactgtgatggaggtcccaaatatgtggtctatcaccactgaattcatgtaatagataagaaaaaaattagaggtggatgtcttgttttgtgtcatgaattactaaaatctcttagtagttgtggtatatttttgagtaaaattaccatttccagatttgagtttgaagggcttttatagttgtattttcctcctcactgttaataatcataatcctttttcagtattttagtggccttgaacaactggtttatctacaatctcaaatcctaagtgtataattatgtgcaatgttcaatacctcatataatacttgctcaacagtatagtggtaccaatggcattaagatggtgtttttgttctacatatttttcaataatttattctttctaatgttgaaattatatcaggctttaccggtttttttagttgtttaaataagtaatattttcaaaagaataaaataaccaatgatatctcttggaataatctgtaaaacgtagttataaaattctattttctactt

SEQ ID NO: 46413 - DNA, 3966 bp, Homo sapiens
  misc_feature (36)..(36): n is a, c, g, or t
  misc_feature (39)..(39): n is a, c, g, or t
  misc_feature (42)..(42): n is a, c, g, or t
  misc_feature (3129)..(3129): n is a, c, g, or t
aaatgggcccgcgggccccctaccaagttccaggcnccnggntaaaccaccaaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgaattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacntgtgggaggaattttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactactattccagt

SEQ ID NO: 46414 - DNA, 2968 bp, Homo sapiens
  misc_feature (2131)..(2131): n is a, c, g, or t
caataacgtctgaatattagggttactgagagttcaagaagatatgttatcttccctgaatacagagacaggcaagttggaaattgcttatgtctggataattttcatttcagcctgcttgaagtggaaacttgaacctttctctaaactgaggagggaagaaatagttcaaactgatgatactaggacaaggtcaactcatattatgaatagttagacttttatgatctttgagaagaaaattgtatattggattttatagtattcctttatttccactttgctgaattagcctagcagcactacccataaacagaacctaagagtaaagagttctaatattagcaccttttattattacatcactaaaataaaatgcaagttaggcctggtggctaaggcctgtaatcgcaaccctttggcaggccatggagggagactagctcgagcccaggagctcaaggccagcatgggccacataatggaatcctgttgctacaaaaaattaaaaaaaaacagctggatgtggtggtgtgtgcacctgcagtcctagctactgaggaggctgaggaaggaggatcacttgagcctgggaggattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagggctggctatttgcctcagaatattcctctggagattatcagatacctgtctgaggagaaggattttcttccttggcatgctgccagccgagctctttatcctctagataaattactggaccgcatggaaaactacaacattttcaatgaatatattttaaagcaagttgcaacaacatatatcaagcttgggtggccgaaaaataattttaatggatctcttgttcaagcatcctaccaacatgaagaactacgtagagaagttataatgctggcctgcagttttggcaacaagcactgtcaccaacaggcatcaacacttatttcagattggatttccagcaacaggaacagaataccactaaatgttagagacatcgtatactgtacaggagtgtcactactggatgaggatgtctgggaattcatatggatgaaattccattccaccacagcagtttctgagaagaaaatattattggaagccttaacttgcagtgatgacaggaatttattaaacaggcttctaaatctgtcactgaattctgaggtggtgctggatcaagatgcaattgatgtcataatccatgtagctcgaaatccacatggtcgagaccttgcctggaagtttttcagggataaatggaagatattaaataccaggtatggagaagcattgtttatgaattccaaactcatcagtggtgtcacagaatttcttaatactgaaggtgaactcaaagagctcaagaacttcatgaaaaactatgatggggtagctgctgcttctttctcacgagctgtggaaactgtcgaagccaatgtgcgctggaaaatgctttaccaagacgagcttttccaatggttaggaaaagctctaagacactaatatatgtatcttataaacaaacaattcaactcagaagtttatgagaagacacgctttttgtggaatgaggaaaatgtactacctagaaaatggccagattttcagtgttaacntgtgggaggaattttttttttagtttttattttttggttttgggggatattttttatttgtttcattcattctgttctgtttctctactgggtgttcctctctaaagaaactcttgcaagtgaaactagccatgattgcttcagctgtacattccttgctgtacaggaccaaatatgatagtgatgcatgttgatgttacagtcaatttggaaaaacatattcagaatatctgtgcatggatatattgtcctgcctgtgttccagcatgcttatttcaaacgtccagtgttgtgtgtgaatatgtgttacacctaggatgggcattatgcaaaagcacaaagattatatatgacaatcagtattgcaatgaaagaaaaactaaaaacagaaatgatattctcaattttgggcaatgtgagaggtaaaatagcccttgacatgatgaacatcacttatttcagcacttggattgtctggcaatgattactgtgttgctaactcattttctttgagttaaagctgtgtatacattttaaaaggcatatagatagtgtatgcatatgtatatgtacatagggaagccccatatgtatatagtatgttgtacactgcacatgtacaaagaatgtcttcagatcaaagaaaatttatctctttttataaacttaaggacagttgcaaaaggcttcaaggaatttatctcaacattattctttctatgtcctaactaaatttctcaactgttatgaatttttcatctacttcttgaacagtggtctattctgctacatgaagatgaatacaaacaaaatttttgtataaactactattccagt

SEQ ID NO: 46415 - DNA, 2576 bp, Homo sapiens
aagaaaaagaagaagaaaaagaggaagaagaagaaggaggaggaggaggaggaggaggagggggccgagaagagcagctcacccttcgcagccgcgatgggggaagacgacgccgcgcttcgggctggcagcagggggctctccgacccgtgggcagactcagtgggagtgcgaccccgcaccacggagcgccacatcgccgtacacaagcggcttgtgctggccttcgctgtgtccctcgtggcattgctcgcggtcacaatgctcgctgtgctgctcagcctgcgcttcgacgagtgcggggcgagtgccacgccaggcgccgacggtggcccctcaggctttccggagcgcggcggcaacgggagcctccctggatcggcccggcgcaaccaccacgcaggcggggactcctggcagcccgaggcgggtggggtggccagtccggggaccacgtcggcccagccgccgtcggaggaggagcgggagccgtgggagccgtggacgcagctgcgcctgtcgggccacctgaagccgctgcactacaatctgatgctcaccgccttcatggagaacttcaccttctccggggaggtcaacgtggagatcgcgtgccggaacgccacccgctacgtagtgctgcacgcttcccgagtggcggtggagaaagtgcagctggccgaggaccgggcgttcggggctgtccctgtagccggttttttcctctacccgcaaacccaggtcttagtggtggtgctgaataggacactggacgcgcagaggaattacaatctgaagattatctacaacgcgctcatcgagaatgagctcctgggcttcttccgcagctcctatgtgctccacggggagagaagattccttggtgttactcagttttcgcctacacatgccagaaaggcatttccttgttttgatgagccaatctacaaggctactttcaaaatcagcatcaagcatcaagcaacctatttatctttatctaatatgccagtggaaacttccgtgtttgaggaagatggatgggttacggatcacttttcacagacccctctcatgtccacatattatttagcctgggcaatttgcaacttcacatacagagaaactaccaccaagagtggggttgtagtacgattatatgcaagacctgatgctatcagaagaggatccggggactatgctctccatataacaaagagattaatagaattttatgaagactactttaaagtgccctattccttgccaaaactagatcttttagctgtgcctaagcatccgtatgctgctatggagaactggggactaagtatttttgtggaacaaagaatactgctggatcccagtgtttcatctatttcttatttgctggatgtcaccatggtcattgttcatgagatatgtcaccagtggtttggtgaccttgtgacgcctgtgtggtgggaagacgtgtggctgaaggaagggtttgctcactactttgaatttgttggtacagactacctctatcctggctggaacatggaaaagcagaggtttctgaccgatgttctgcatgaagtgatgctgctggacggtttggccagttcccatccagtatcacaggaagtgctgcaggcaacagatattgacagggtgtttgactggatcgcatataaaaagggtgctgctttaataagaatgctggctaattttatgggccattcagttttccagaggggtttgcaagattatttaaccattcataagtatggtaatgcagccagaaatgatctctggaatacattatcggaggctttaaaaagaaatgggaaatatgtaaatatacaagaagtaatggatcagtggacactccagatgggttatcctgttatcaccatcttgggaaacacaacagcagaaaatagaataataattacccaacagcattttatctatgatatcagtgctaaaactaaagcacttaaacttcagaataacagttacctgtggcagattccattaactattgtggtaggaaatagaagccatgtgtcttcagaagcaattatttgggtgtctaacaaatcagagcaccacagaataacttatttggacaaaggaagctggctgctggggaacatcaatcaaactggctattttagagtcaactatgacctaaggaactggagattattaattgatcaattaatccggaatcatgaggttctttctgtcagtaaccgagcgggcttgatcgatgatgccttcagcctagccagcttatacatttgagatatattagaagcctgggaattcagcataatagccactgaaaatataatggctaaagaagaagaaaattatgagaacatttcaaaaacttacagattttttttttcatttctgagcctggtttcagaaatggaaacagcattgttaaaataaccttaacaacatttgcaaactgtggaagtaatttgctccttttgggacatttttcggcatggcttttgttagaagtttttttgtgtcttctggatggctctcttgtacctcgtttaaggtttctcttg

SEQ ID NO: 46416 - DNA, 1351 bp, Homo sapiens
gccgagacacctcgaggcctggaggggtggtgggtgctgaccgcgcccctctgcctctccaaggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 46417 - DNA, 1843 bp, Homo sapiens
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 46418 - DNA, 1872 bp, Homo sapiens
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtgaaaaaaggccttcgtggcctcgagagatc

SEQ ID NO: 46419 - DNA, 1349 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtgagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 46420 - DNA, 1554 bp, Homo sapiens
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 46421 - DNA, 1829 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 46422 - DNA, 1540 bp, Homo sapiens
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 46423 - DNA, 2166 bp, Homo sapiens
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactggggggggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtgaaaaaaaaaaaaaaaaaaaaaaaaaaatttggggggggggggccgaaagaaggtttttaaaaaccattagcggtgggggcgcgcgcgcgggcgcccaggtgggttagggacgacatggggcccagaccggggttcacataaggagaacacccgggcgccagagactaatggaggcggggggttccttccccaattataaaaaacgcgcggggggacacccgagggggtcgcggaacaatcccaaaggagagtccggagggccataggggcgtctctatcacgggggccaaaggagagccgataataaatagcgcggggaggcg

SEQ ID NO: 46424 - DNA, 360 bp, Homo sapiens
tcaaaatccagtaaaagactttaatgaatgtaaaatgctatctgaatctggacattactgttttaattccaatagaattttctcatgtgggttaaaaggacaatcagcttatatttcctactatattttcatctagcacaactcttaaagcaagtctattttagttatatattattttatcatggttcctggaaggtaagattggtggccaccacattcagtctccttcacagctaagtgtagccacataactatgctttggccacggggatatgaatgctactactaattttttcccttgaaacaatgggatgttgactttcttgctcccttcctccttactgcttattgggagatggc

SEQ ID NO: 46425 - DNA, 408 bp, Homo sapiens
cactgcacacggccttacttttagaacttttaagattttctttcacatgtaggtctgtgatccattttgagttaattttgtaatatggtgtgacgtatggattgaagtttttttgtgtgtgtgtgtatgatgagccactgttccaacaccatttgttgaatagattccataaattactctttctcaagtgaattcctttgcatgtttgtgaacaaaaatagtttattgtttataaaaaaggcttttttgtgtatatacacacacacacacacacacacaaatacatgtgtatgtttttctgtattctataatttagtccattgatctcttgtttttatgtaatatcatactttcttgattcttgaagctttgtaatcttgaaatcagtttgtatagtcttccagattt

SEQ ID NO: 46426 - DNA, 443 bp, Homo sapiens
caggaatatttcacggcatcaaagacatggccagaaagcaaaaagatgtatacacacacacacacacacgcacagttcttctgtatctcacaaccctgataccacatatggcctttccgaagggagtattgtatgttgtttagtcttggaacttcttttaaagataggatgtcatttacaatcctcaggccatatgtttactcagacttaagaaacatgggctaatctttttctattttgaggagtaataaattgaaaagataattacataatatggtgcataatgtaactctggcttgagccatatgtgtttaattttagaaaaacatgcgtgatgacaggttatgaaaggatgaaactattttagtctttttaaggattagaagcatgatttttaaaatgtgtgttcccgccaccccccaccccagcctccaaaaaacaac

SEQ ID NO: 46427 - DNA, 453 bp, Homo sapiens
caatttttgcgtttttagcagagacggggtttcaccatgttggccagactggtcgcaaaactcctgacctcaagtgatctgcccgcctcggcctcccaaagtgctgggattacaggtgtgagccactgcgcttggccatgttggtggcattttaaattttttagcatctctttttccccacataatttcttgttctcacttcatacgatatgttgaaaactcttgtgggcatgtgtaaacctgaaaagattttgtcagcttaaatagttttattggcacctttgggcaagttgctgactgttccatgctttaaaaagcactattttctatctttggccatgtctgtaataaagttcttcatttctacacctctactattgaagttagagtagtgagcaaaataagtgaggttcatgctctcatagggtttacagactaagtgtctacacattt

SEQ ID NO: 46428 - DNA, 524 bp, Homo sapiens
ttctttaaaatttgtttaaattgttcatttatttttacttttaatttgggcatatagtaggtgtatatatttatggggtctgctttcaacaggagtatctaaaatgtacaattgctaatggtactgaaacagattacctgtgtaaatctttgccttcaactcctagagattaaggacctttcatgaagaatgctccctaagcctatttctaccatttatctggaaaccagtctgcaaacttgtgacctctttgttatgttagaaaacataagctgtgctctcacttatataaatcagtgtttctttcctctccaaatattcctgggaacattaatttgcctgctgttggctagccaatctaccatccccggaattaaagccagagactaacagaaaattgagactcaatttgggactttttgacaaggaaattaatgaaaaaaaaaaatggaaaccaaacaagacaatacaggatcagaatgagctgtcagtggaccactcacccccactttccctgcatgcat

SEQ ID NO: 46429 - DNA, 420 bp, Homo sapiens
ccactcaccagcaatgctatactaggcttcagtgtcttatgaagaatggtagtacttcacagagattaaggacctttcatgaagaatgctccctaagcctatttctaccatttatctggaaaccagtctgcaaacttgtgacctctttgttatgttagaaaacataagctgtgctctcacttatataaatcagtgtttctttcctctccaaatattcctgggaacattaatttgcctgctgttggctagccaatctaccatccccggaattaaagccagagactaacagaaaattgagactcaatttgggactttttgacaaggaaattaatgaaaaaaaaaaatggaaaccaaacaagacaatacaggatcagaatgagctgtcagtggaccactcacccccactttccctgcatgcat

SEQ ID NO: 46430 - DNA, 443 bp, Homo sapiens
ggggagggcttaagggctctctgtggtgtgcatggttggagacagcttctggaaggcatccatgagggtggaagaggtggaagggagatgaccagaagaaccctgtccatcttgagctgggggtaaaacaatggagatggcgaaggttttcttccatgggtctcccaaactccgtctctttcgcaatcacagccacatttctggctctcagctccttttggatcaaacgaaaagcaccagaaccttccctgacctgcagactccccacccaaactgaagtctctgatgagaagagcctgggagctgtcccactgccctgggacccaggagctgagcacccggacaccaagatgccaggcgagtgccaggaggcctgcaccaaggggtgttctggccacccgagctggccctctgctaggcttcagggacttgggcccaggact

SEQ ID NO: 46431 - DNA, 6220 bp, Homo sapiens
tgtgcagaattgtacagttgcgaaaccatgtcgctggcagctggtgctggcggtggagacttccctgtgcggtgctcagtgcatctgcacccgtgggggagggagctctttctctggccctgcagtcacctgaggttgttaccattatgaacggccgctgggacccccgcatgtgcatgtactcccccagagtgtccgggggccccagccaagggacacatctcacgcagctgggaacatgtgcaggctgatgaagagaaccggatgagggcttcacatgaggaagcatgtggccaggtcctctcagaacatcagcctcatcttcctgtctctgatctatttcaccaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatattgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggaaaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcgggatcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccagtat

SEQ ID NO: 46432 - DNA, 5641 bp, Homo sapiens
tgtgcagaattgtacagttgcgaaaccatgtcgctggcagctggtgctggcggtggagacttccctgtgcggtgctcagtgcatctgcacccgtgggggagggagctctttctctggccctgcagtcacctgaggttgttaccattatgaacggccgctgggacccccgcatgtgcatgtactcccccagagtgtccgggggccccagccaagggacacatctcacgcagctgggaacatgtgcaggctgatgaagagaaccggatgagggcttcacatgaggaagcatgtggccaggtcctctcagaacatcagcctcatcttcctgtctctgatctatttcaccaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatattgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggaaaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcaatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcgggatcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 46433 - DNA, 5723 bp, Homo sapiens
tgtgcagaattgtacagttgcgaaaccatgtcgctggcagctggtgctggcggtggagacttccctgtgcggtgctcagtgcatctgcacccgtgggggagggagctctttctctggccctgcagtcacctgaggttgttaccattatgaacggccgctgggacccccgcatgtgcatgtactcccccagagtgtccgggggccccagccaagggacacatctcacgcagctgggaacatgtgcaggctgatgaagagaaccggatgagggcttcacatgaggaagcatgtggccaggtcctctcagaacatcagcctcatcttcctgtctctgatctatttcaccaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatattgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggaaaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcgggatcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 46434 - DNA, 5682 bp, Homo sapiens
tgtgcagaattgtacagttgcgaaaccatgtcgctggcagctggtgctggcggtggagacttccctgtgcggtgctcagtgcatctgcacccgtgggggagggagctctttctctggccctgcagtcacctgaggttgttaccattatgaacggccgctgggacccccgcatgtgcatgtactcccccagagtgtccgggggccccagccaagggacacatctcacgcagctgggaacatgtgcaggctgatgaagagaaccggatgagggcttcacatgaggaagcatgtggccaggtcctctcagaacatcagcctcatcttcctgtctctgatctatttcaccaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatattgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggaaaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcgggatcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 46435 - DNA, 1825 bp, Homo sapiens
agggccccaaggtgtggtgtgcgtccagctcagctgcttcctctttcagggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcgggatcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 46436 - DNA, 527 bp, Homo sapiens
aaaatggtagtgtaagttctttttgttgttaaaataggaaaaagggttaaaaaatggaccgaaaaaataaagtatccacttctatacattttatatatcttgtgtactgttaaaaaattaataggaaaatatgaaactcttcatttccataagttgaaaaacaatgatacagctgctttgtgggttttccttttgggggtgataaaaatgtttcggagttaggtaaaggtggtggttgcacaccattgcaaatgaacagttcagtgcaaatgccactgaattgttcactttaaaatcgctaattttaagtaatgtgagtttaatatcaaaataagagctaaataacaataaaaatttggaagataggaaaatgatggagttagattgtacccttaaataaaaccaggaaataattcttcagtttttgagtgatttttccccagtggggcccaattttggctaagctgtccactcacttatgaccagagatagagacaaaacaaacatttgtgacatgaatgcccagt

SEQ ID NO: 46437 - DNA, 359 bp, Homo sapiens
aatcgccatcccctacccccaacaccttaaaaaaatgataataaagtacatgaagacagttttagagctttaggtttcccactgaggtttggagcttctctcatgggaaccggtccccaggctgcattcacgaattgctctcatctccattctcccacaggtttgttctccacccgtaccccccacctcgcccggctatcttactccctgcgatttctataggaaaaagtgtgttcttggcagggcgtggtggctcatgcctgtaatcccaacactttgggaggccgaggcgggcggatcacctgaggtcgggagttcgagaccaacctgaccaacatggagaaaccctgtctctacta

SEQ ID NO: 46438 - DNA, 427 bp, Homo sapiens
ttcactttaaatgaacatagctactactgactaaaatacctgtttttgtagtttggaaagtatccacaattcttcctgatgtgaaccttgtcaaaggccaaaacagacacgcttgctgtgggagataaactttctaattgtttaattgtgaaaccacccttaaagaaagaaacatatttatgtaggctacagtgttgagcacttaagtcctctgaaagttctcttctaaatacaaatgattttgtttctgtcttccattgcatcatgtcactttgctttacatgtgattatagctattctagatattcattagtcatattcatagtagtatctgtgtatgctcaatccagaaaactaaaaaatacagtagcataagtaatcttcaaatgtaaagtagcataaataaatgtcaatcagatgggatatt

SEQ ID NO: 46439 - DNA, 605 bp, Homo sapiens
tggacgtggggtcggtcggctttgccccaaattagccgggaactcgagaccaaggtctgagaatttattaaagctccctccttggtccttcctccctggtccttccctccgctcctctctctttgcctcccctgtcgtcccctcctctccacctctggagtgcctggggtgccaccctctggcgcgcagagggaactgaacaggaagagcctccgaacaggtgaaccactagagacctgctccagtctccccagactaagcgccttcggtcctgacctggctggcagtaggccatgattcttgaaattcagtacagtgagacggcggaccaatgctaggcatcttccgcctggccgctgcggaaaatccatctgctgttaacgccaatgccaaggaacgccgcggatgcccttggttctggcagccactggaaggcagggataagacattcccggcggataggagagggagatgcaagtcagtgttttggaagctgcactggtgtatttttatttcattttccatggcttaggtgccaatgtattttttttttttttttcaggaaaaaaagctaccaaactaataagattgtttttctaaaacta

SEQ ID NO: 46440 - DNA, 338 bp, Homo sapiens
ctttcagagctcaactcaagtaccgtttcttccaagtctttaggaagtttccctgaaatgcctggttatggcagagtctctctggtctatgctattgagtaattaggtttctggtacttatcacagtttccagtgacagtttggtaaatgtttaacagctggctctatggggggaagaaaagtgccctggtgtatagagtttgctgattttggtggtgtaaatactcccagcatggtgatttcaagctgccagtgtgatgatattgaatgtcgagttggaaagagaggctcagtagcaagccattacatagcatttacaccatacagatgcaaatatg

SEQ ID NO: 46441 - DNA, 325 bp, Homo sapiens
aacatgtgcagccctggtgtgttaaaatgtgaaatattttaagggtgcagtcatttcttcctcctcagcacctgagcttctgctgatctctcactgagatagcacagcctccctgccataggactttgctaggcagccactcgctgggcacagcccctgaataattcatggacagcccagtcactcaggagcgccaaggcctgccagctgcctcgtaagtaggaggcaggctccagattactgtaaaataaatactatagctacctctgagaccttctttacagacaccataaaacacccttccctctttgctttatctccccat

SEQ ID NO: 46442 - DNA, 278 bp, Homo sapiens
gaaaagaaataagaaagatcagagcagaactaaatggaattaaaataaaaaaaaaagtatacaaagcttcaatgaaaaaaaagttgtttttttataagaataaacaaaattgatagtctactagctaggttaaccaagaaaataagagaggagattcaaataagcacagtcagggccgggcacggtggctcacgcctgtaatcccagcactttaggaggccgaggcaggtggatcacgaggtcaggagatcaagaccaacctggctaacacggtgaaa

SEQ ID NO: 46443 - DNA, 408 bp, Homo sapiens
tggccaacatctccccaatccccctgcctttcagctcttgagcatcatttaactctttttatgagtttgactttttcagattccacatataattaagatcatgaggtattcttctgtgcgtgatttacttcacttaatgttttctaggttcatccatgttgttgcaaatgacaggatgtccgtcttttaagactgaatagtatttcattgtgtatatatcacattttctttatccattcatccatggacacttaggctgattgtgtatagtggctattgtgaatagtgctgcgatgaatacaagtgcaggtatttcttcaacatactgatttcatttcctgtggatatatacccagtggtgggaatgccagataagttctatatttaagtttttgagaaaccaccata

SEQ ID NO: 46444 - DNA, 1336 bp, Homo sapiens
cgaataatttttgtatttttagtagagatgaggtttcaccatgttggccaggccagtcttgaactcctgacctcaggtgatccgtctgccttggcctcccaaagtgctgggattacacgtgtgagccaccatgcccagcctactcaaataacgttttttataatacagagaatttataaggtagagctgttctgtctaaacagtagccactaactacatgtgtccatttaaattcaaatgtaaaataattcaaattaaataaatcaagttcctccagcttactggccacatttcaagtgttcaatagccacttgtagtgagggctaccatattagataacacaggtatatagcatttccactgtcacagaaagttctgttggacagttgatatagaggttggaaaagaatgatttttttttaaatgagtgcttaatgaaaatagtcatttaagttggtaaaccggatcataaatcacaaaattctttgcccttgatatataatattagctgccatttatgaggtactagctaagtgtcagattcagtctaaatggtttatagtcattttctcttcctcttatttcatccttgggtaaggaattctgtaaggcagataccttaatctttgtttgatagttggaaaaattgagatttagagaggttaatttaatatctcagaatcatagctaagtgactgagccaagatttaaatctaagtctgtcagactactgctcccattcttaaggctttgctcttaactactgcactccttgccatatattgcacttctcctgtgcatccccccaaatattattaatcacatttgagtatctcttacattccagaaattttaaatgtatttctaattcttacaagaattctaagaaccctgttaggtagatactaatctccttttgtagatgtgggaactcaggctaagagttgttaaataacttgccaaagacattaaagcttgtgagtgagaaggacctaaactcattatctggagcctattctgattttggttttggtttgtttgttttttgaaatgatctcactccatcacccaggctggagtgcagtggtgcagtcataactcactgcagcctcttaactcccaggctcaagcaatacttccccctcagcctccccagtagcaagtaaaaaaaaatgtagctgggcctggtgtcacaggtctgtggtcccagctactcaggaagctgaggtgggagagtctcttgaccccaggcggtcagggctacagtgatctatgattgtgctactgtacaacagtacagagcctgggcaacagagagaccctgtctcaaaaaaaa

SEQ ID NO: 46445 - DNA, 322 bp, Homo sapiens
attaccgggtcgactactataattaaattaacgaccgggtcgaccaaggctgccccgcaggataaggcagccctcctccctggtggggatccagacaccccacagactgagccacaggtccctgaagagtccgcagaggccgtatcaccctcttcaccctggtacctggagccctccagggttgtgagatccagcccaatctcagccttgagatggatgggatggattccactcacttggctcccctctcctccttggccagaaaccttcagaaggaaacagaaggatgagatgggcctggcaagtcgacgcggccgcgaat

SEQ ID NO: 46446 - DNA, 4164 bp, Homo sapiens
cgggtcctcagcctggaatcaccccttgagaaggaccccagagtcctcggcgcccagtccgtcccccgaggcagggcactgaaggggttaagtcccctggggctggattccgccttccggcttttcccagaccccagagccggtccctggaacactgcagtcctgagctctgggatggagcccgagactgcgctgtggggcccggatctgcagggtccggaacagagccccaacgatgctcacagaggtgccgagagtgaaaacgaagaggagagccctcggcaggaaagttctggggaggagatcatcatgggagacccggctcagagtccagaatccaaggactcaacagagatgtccctggagagatcctcccaggacccctctgtcccccagaaccccccaaccccactgggtcactccaatcccttggaccaccagatccccctggaccccccagccccggaggtagtccctaccccatctgactggaccaaggcctgcgaggccagctggcagtggggcgctctcaccacatggaacagccccccagtcgtccccgccaacgagcccagcctgcgggagctggtgcagggccgcccggcgggggcggagaagccctacatctgcaacgagtgcggcaagagcttcagccagtggtccaagctgctgcggcaccagcgcatccacacgggagagcggcccaacacctgctccgagtgcggcaagagcttcacgcagagctcgcacctggtgcagcaccagcgcacgcacaccggcgagaagccctacaagtgccccgactgcggcaagtgcttcagctggagctccaacctggtgcagcaccagcgcacgcacacgggagagaagccctacaagtgcacggagtgcgagaaagccttcacccagagcaccaacctcatcaagcaccagcgatcccacaccggcgagaagccctacaagtgcggcgagtgccgccgggctttctaccgcagctcggacctcatccagcaccaggccacccacacaggcgagaaaccctacaagtgccccgagtgcgggaagcgcttcggccagaaccacaacctcctcaagcaccagaagatccacgcgggcgagaagccataccgctgcaccgagtgcgggaagagcttcatccagagctcggagctgacccagcaccagcgcacgcacacaggcgagaagccctacgagtgcctagagtgcggcaagagcttcggccacagctccaccctcatcaagcaccagcggactcacctgcgcgaggacccgttcaagtgcccagtgtgcggcaagaccttcaccctgagcgccacgttgctgcggcaccagcgcacgcacacgggcgagcggccctacaagtgcccagagtgcggcaagagcttcagcgtcagctccaacctcatcaaccaccagcgcatccaccgcggcgagcggccctacatctgcgccgactgcggcaagagcttcatcatgagctccacccttatccgccaccagcgcatccacaccggtgagaagccctacaagtgttccgactgcggcaagagcttcatccgcagctcccaccttatccagcaccgccgcacgcacaccggcgagaagccctacaagtgccccgagtgcggcaagagcttcagccagagctccaaccttattacccacgtccgcacgcacatggacgagaacctgttcgtgtgctccgactgcgggaaggccttcctggaagcccacgagctggagcagcaccgggtgatccatgagagggggaagaccccagcgcgtagggcccagggcgacagcctgctggggctcggggacccctccctgctgaccccgccgccgggagccaagccgcacaagtgtctcgtgtgcggaaagggcttcaacgacgagggcatcttcatgcaacatcagaggatccacatcggagaaaacccctacaaaaatgcagacggcctcatcgcacacgcagcccccaaacctcctcagttacgatccccaaggctccctttcagagggaattcctaccccggggctgcggagggcagagcggaggcccccggacagccccttaagccgccggagggtcaggagggcttcagccagaggcgggggctgctgtcctccaagacctacatctgctcccactgcggagagagcttcctggatcgctctgtgctcctccagcatcagctcacccacggcaacgaaaagccctttctctttcctgattatagaattggcctaggggaaggcgcagggcccagccccttcttaagtgggaagccctttaaatgccctgaatgcaaacaaagctttggcctcagctctgagctgctgctgcaccagaaagtccatgcaggcgggaagagctcccagaagagtccagagctggggaagagctcttccgtcctcctggagcatctcaggagccccctgggggccagaccctaccgctgctcagattgcagggcctccttcctcgaccgcgtggccctcacccggcaccaagaaacccacacccaggaaaaaccccccaatcccgaggacccccctccagaggcagtcaccctgtccacagatcaggaaggtgagggcgagacccctacccccacagagagcagcagccatggggaagggcaaaaccccaaaaccctagtggaagaaaagccctatctgtgccccgagtgtggagccggcttcacagaagtcgcagccctcctgctccataggagctgccacccaggtgtctccctgtgaaatgggtctggagaccaggggcctcgctctctccagagaggaacactggattttttcccccaaaaaaattacatggggaagggaggataaccctatcagatggtagtggagtggaggagaaagaaccctgggaaaaaatagtgcttttacatcagtgatgagaaaccctataaaattgttggtgggaagcacttataaggcagtagagaaaaactgttgggttagaaaccctataaatatgtaggaaaaaaaaaagccctttaagtctgtagcagaaaaaccctataaaccatagtggataaaagccctattaattgtaggaagaggtcccaatatgtctctgaacaaccctataaaattgtatcaaaatccttaggaaaatcctatagggtcggggaagtaccgcaatggcactgacccgggagtaacgaccctcagatgatgcagaaaacacctctccctcactgttccacaatgttctctcccagcagccctggacagttctcatggaggaagatgctcagctgggggagtggtgtgggaactgggtggaactgaaaaggaagaaaataggagaaaaataagtgaccaggggctctggagcccccagaggagataagacagagactaggaagaaaaggtcccactcactgcactggggtccttggggtttgaggacaatgttagatgcattgtgtgttttagggaaagaggcctatggaatcccttatcaaaaccccaaaatggggaagaaaaaacaaattggcaagcctttttaaaggctgaagtttggggtgcagaaacatggtcagtataagaatactgagaaaccaccacaaaaattagggggaagcagggggcagtttctgttagattgctttgaggggagcaaaccaaggtggggaaactgctcacatggaacccagctaactccaggccccttcttgcttccggaagcttgcgaaactgcaagtagcaggcaggtcccagctctcagagtgcaagggttctccccacaccaggcaggaccaccctttctccctgcccagccagggacttctactctgcaaggcctccagggatggcggttgcctcccaccacattctcaggtctcaccttcaggaggtttttcctgaaatctaactgccgccagtggcagctcatttcctcaaattctgtcctcagtggagagggagaaccgctgctagtcgacctccaaagaataaagcccttcagagacttaggggaagccccagtcaccggacttgtccccatggagtgaagagaggccccatttttgagtgttgtgtgtccaaaacagtgttgtgtcactggtggtcatgttgcttagttgaagagaataaagggaataagatttc

SEQ ID NO: 46447 - DNA, 6046 bp, Homo sapiens
cgggtcctcagcctggaatcaccccttgagaaggaccccagagtcctcggcgcccagtccgtcccccgaggcagggcactgaaggggttaagtcccctggggctggattccgccttccggcttttcccagaccccagagccggtccctggaacactgcagtcctgagctctgggatggagcccgagactgcgctgtggggcccggatctgcagggtccggaacagagccccaacgatgctcacagaggtgccgagagtgaaaacgaagaggagagccctcggcaggaaagttctggggaggagatcatcatgggagacccggctcagagtccagaatccaaggactcaacagagatgtccctggagagatcctcccaggacccctctgtcccccagaaccccccaaccccactgggtcactccaatcccttggaccaccagatccccctggaccccccagccccggaggtagtccctaccccatctgactggaccaaggcctgcgaggccagctggcagtggggcgctctcaccacatggaacagccccccagtcgtccccgccaacgagcccagcctgcgggagctggtgcagggccgcccggcgggggcggagaagccctacatctgcaacgagtgcggcaagagcttcagccagtggtccaagctgctgcggcaccagcgcatccacacgggagagcggcccaacacctgctccgagtgcggcaagagcttcacgcagagctcgcacctggtgcagcaccagcgcacgcacaccggcgagaagccctacaagtgccccgactgcggcaagtgcttcagctggagctccaacctggtgcagcaccagcgcacgcacacgggagagaagccctacaagtgcacggagtgcgagaaagccttcacccagagcaccaacctcatcaagcaccagcgatcccacaccggcgagaagccctacaagtgcggcgagtgccgccgggctttctaccgcagctcggacctcatccagcaccaggccacccacacaggcgagaaaccctacaagtgccccgagtgcgggaagcgcttcggccagaaccacaacctcctcaagcaccagaagatccacgcgggcgagaagccataccgctgcaccgagtgcgggaagagcttcatccagagctcggagctgacccagcaccagcgcacgcacacaggcgagaagccctacgagtgcctagagtgcggcaagagcttcggccacagctccaccctcatcaagcaccagcggactcacctgcgcgaggacccgttcaagtgcccagtgtgcggcaagaccttcaccctgagcgccacgttgctgcggcaccagcgcacgcacacgggcgagcggccctacaagtgcccagagtgcggcaagagcttcagcgtcagctccaacctcatcaaccaccagcgcatccaccgcggcgagcggccctacatctgcgccgactgcggcaagagcttcatcatgagctccacccttatccgccaccagcgcatccacaccggtgagaagccctacaagtgttccgactgcggcaagagcttcatccgcagctcccaccttatccagcaccgccgcacgcacaccggcgagaagccctacaagtgccccgagtgcggcaagagcttcagccagagctccaaccttattacccacgtccgcacgcacatggacgagaacctgttcgtgtgctccgactgcgggaaggccttcctggaagcccacgagctggagcagcaccgggtgatccatgagagggggaagaccccagcgcgtagggcccagggcgacagcctgctggggctcggggacccctccctgctgaccccgccgccgggagccaagccgcacaagtgtctcgtgtgcggaaagggcttcaacgacgagggcatcttcatgcaacatcagaggatccacatcggagaaaacccctacaaaaatgcagacggcctcatcgcacacgcagcccccaaacctcctcagttacgatccccaaggctccctttcagagggaattcctaccccggggctgcggagggcagagcggaggcccccggacagccccttaagccgccggagggtcaggagggcttcagccagaggcgggggctgctgtcctccaagacctacatctgctcccactgcggagagagcttcctggatcgctctgtgctcctccagcatcagctcacccacggcaacgaaaagccctttctctttcctgattatagaattggcctaggggaaggcgcagggcccagccccttcttaagtgggaagccctttaaatgccctgaatgcaaacaaagctttggcctcagctctgagctgctgctgcaccagaaagtccatgcaggcgggaagagctcccagaagagtccagagctggggaagagctcttccgtcctcctggagcatctcaggagccccctgggggccagaccctaccgctgctcagattgcagggcctccttcctcgaccgcgtggccctcacccggcaccaagaaacccacacccaggaaaaaccccccaatcccgaggacccccctccagaggcagtcaccctgtccacagatcaggaaggtgagggcgagacccctacccccacagagagcagcagccatggggaagggcaaaaccccaaaaccctagtggaagaaaagccctatctgtgccccgagtgtggagccggcttcacagaagtcgcagccctcctgctccataggagctgccacccaggtgtctccctgtgaaatgggtctggagaccaggggcctcgctctctccagagaggaacactggattttttcccccaaaaaaattacatggggaagggaggataaccctatcagatggtagtggagtggaggagaaagaaccctgggaaaaaatagtgcttttacatcagtgatgagaaaccctataaaattgttggtgggaagcacttataaggcagtagagaaaaactgttgggttagaaaccctataaatatgtaggaaaaaaaaaagccctttaagtctgtagcagaaaaaccctataaaccatagtggataaaagccctattaattgtaggaagaggtcccaatatgtctctgaacaaccctataaaattgtatcaaaatccttaggaaaatcctatagggtcggggaagtaccgcaatggcactgacccgggagtaacgaccctcagatgatgcagaaaacacctctccctcactgttccacaatgttctctcccagcagccctggacagttctcatggaggaagatgctcagctgggggagtggtgtgggaactgggtggaactgaaaaggaagaaaataggagaaaaataagtgaccaggggctctggagcccccagaggagataagacagagactaggaagaaaaggtcccactcactgcactggggtccttggggtttgaggacaatgttagatgcattgtgtgttttagggaaagaggcctatggaatcccttatcaaaaccccaaaatggggaagaaaaaacaaattggcaagcctttttaaaggctgaagtttggggtgcagaaacatggtcagtataagaatactgagaaaccaccacaaaaattagggggaagcagggggcagtttctgttagattgctttgaggggagcaaaccaaggtggggaaactgctcacatggaacccagctaactccaggccccttcttgcttccggaagcttgcgaaactgcaagtagcaggcaggtcccagctctcagagtgcaagggttctccccacaccaggcaggaccaccctttctccctgcccagccagggacttctactctgcaaggcctccagggatggcggttgcctcccaccacattctcaggtctcaccttcaggaggtttttcctgaaatctaactgccgccagtggcagctcatttcctcaaattctgtcctcagtggagagggagaaccgctgctagtcgacctccaaagaataaagcccttcagagacttagggcctgcgtgtgggcctccccagccttctccaagtcatcagggccacagaatttcttagaaagctttgattagccagcaacttgattttaaacttcagctattcatctttgttggtagcaaggctgccccgcaggataaggcagccctcctccctggtggggatccagacaccccacagactgagccacaggtccctgaagagtccgcagaggccgtatcaccctcttcaccctggtacctggagccctccagggttgtgagatccagcccaatctcagccttgagatggatgggatggattccactcacttggctcccctctcctccttggccagaaaccttcagaaggaaacagaaggatgagaaagcctcccttgccaggcccatctcacctcccacaccacacagttacacattcataaacagccaagcctgctcacaggcctgggcatatgtggctggggagagactgttgccctatgagatggtggaagacagaaaactcttgaatgaaacatctgtaacaagactcccactccctaatcctggagaccccttcaaaaggagaggactctgctcagcgctgggtcagaaaggaagtgcttgccaaccccagtaatgcgctgtcctggagtaagaggactgagatgccagctgtggggcccgtcaggagtcacgtctcaagagaggggtgacccagatttttgcaaagctgtggaagagacctctaattccatgacctaaagtttcacacaacctttatgcaaatccttcgccatttgtctatcctggccccagcaggatgaccctcacatttaaaaggatcaaaatctcaaacattgtgggaggaaaacgccaggcctgctggggagagggagaaggcaggcctcaggattgtgcggagaaccatgttgccatctgcataacgccccagcctatccaagtgccaggaagggaagcactactgaggggggtgctgcctgtgggtctcttcctaacagaacgccaacgaagggggtgccctgtaagaatgagaagtctgccaagtctaaggagatgtccccctccccaagatggtagcagaaactgaagttgtaaagacaaacctctcgcaaagccagaagcagatgctctcaaaaacaggcctaaggaatctgttcccagaagaggcctggggagcagcttttggggctcagaggccagtctggggggaggcaggcagtgtgactgaaggccggcgcaggcctgtttcggactagggtgtagcatatttagtaggatgctcacatgttgtagggatgggtgagggctaaggggcttggctcttgtacgggatggatgatgtgagcgcacagttcgtagggtcaggcgtcttgcggtaggaaaggggcagggttcgatacctctggggtgtggcgtgttctctcttgcccacctccccaagctcctttaaccaggagcttccctcccagagtgagctacgtcttgggaggattgaagcagggaggtggcagtggctagagttgctcagatcggctcagatgaaggcccaggggtcaaagcatttgctcaccacaactgagtctggaaggcactgtgcagccaaaccctcttgtccaatcacatgcaggccccaggcccctcagaaacgccctggtggagggaggagcccaacagatagggtcagggagtcagtggggaaagcagaggggagagcttagagtgaaacttgaaactgctatggacatggaggtcagatgggaacttggaactgggcatgaatcctgaatggtggggaaacttgaagccatcacagccaagaggtggggttccatgacctgccctgaggtcagcagctcccagactcctttgccctcactagggaagccccagtcaccggacttgtccccatggagtgaagagaggccccatttttgagtgttgtgtgtccaaaacagtgttgtgtcactggtggtcatgttgcttagttgaagagaataaagggaataagatttc

SEQ ID NO: 46448 - DNA, 211 bp, Homo sapiens
taaaggaaattttaatggagtgtggattttacaactgtatattatggagaatgtggaaatagcattgtcatttgattcttatgatgtatttgtgaaatcattgtttagctataaattgatgtccttaaaaatgttagaaaattttggacctctgctttatccctgagattaaataaaaacctgtctttagaattaagacttctcaacatct

SEQ ID NO: 46449 - DNA, 824 bp, Homo sapiens
ggcacgaggataaacaaaaggaagaaaataacaatcacatgtaacctaccaattgttgttattttgagagagatatttcttcagacttttctgatgcacatatgtcatataatatttttacaagaatgggactgtaccgcaatactgttttacattttttcactccgtacactcatatgtctgtatcatcttcttaatggctccatagtagtccatagtatagatgtctgccccatagtttatttaacaagtttctattgttggacattttgtttgtttccattttttttttattgttctgaagttgtggtctccaaagtgaggtagacagggatgattctttgggaatataagaagaccgtatttggaattttctgttgatctttgtttttatccttaaggccagtgagagagggaattaaactttctccatctttggatattcccgacttatgccagcaccctcactgtgccccattagcagagcttatgtgttacgtacatagggcaccaacgtttcccaagggaaaaatgggatttccacagcactcacaggctgatggtggcctcgtcacttggcatcatcccatgttctttcactctcaagatattgcaacaagatacccagttgagtgaatgtatagataaccccagagtttcagtgacatctttttataaggtggaaggcaaccatgggaatatttcctattacacagaggcttcctagtattttgacaaagtacttttaaaagtttttgaatttaaagatcctcaattttatacttttcttttaccaaataaataaataaattcttggcgtaggg

SEQ ID NO: 46450 - DNA, 716 bp, Homo sapiens
tttgtttgttttgttttgtttttttttaagctcattagctgttgttagtgtactttttgtgtggcccaattcttcttccagtgtggcccagggacgccaaaagattggacacctctggcgtagagcctctctatacccctggcccatgtctgtcttctacatgtagccaatgaaaggaatctaaagctggaagggcaggggacctttctgatgctcttgtgaggcaaagggattgagatcactgcagagaagctggcaacaggaggcccatcattttttcagtgggcaggacatctccattctgggtggaggaagacgcaaggctttggcaaatactaaaatgcttgtttgtctattgctctttctttatgtccatcacagtctgggaaccagtaccttgaagcactatccttgattaatttataattttctgccctatactgactgcctaggaaagaggtggtcagaggtacgagagggtgaaaatactgttcttaattatgaaaacctatatctgttctgtgtatccatggataattttagtcttctaaattgatttgttattttccaagctttatttttataaaaagtcatttttcagtaaacatataacattgtcaagaactacctaatccatgtacataaaatgtcatgtgaatgtataaatatgtatataatgtataaaaataaaattattctaatttttaaaaaaaaac

SEQ ID NO: 46451 - DNA, 363 bp, Homo sapiens
ctggagtcatcggggatgcttcataaagtgtggagcagacctagagaaaggttatgaaaatgtacaatgcttttccatcgttgtagcttcatgcagacattatatatcatgaaatgaccatatgtttgagtaaccatttatatggaagatgagagagtttgaaagttcatttttttgatacaaagtattttctactcagtcgcagccttttctatctcagtatatcatcatttatcttgctttgaatgaacttgagtacatatagttgtgtgtatatgtatatatatacacacacatgcaaacacatgcatacacacacacctatatatacatctgtatagatgtatgtatatgtacatgtac

SEQ ID NO: 46452 - DNA, 1131 bp, Homo sapiens
  misc_feature (17)..(18): n is a, c, g, or t
cacgaggccgctcccgnngccgccgccgccgccgccgccagaggagcagcagcgcttgtgcaaacggggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaagtgtctttttctctcctaaaagaaaatttttgagtcagtctttacaattacataattttatagatctggtcatgttgtataatagtgaaaaattaagttttgaatctagccctatttgtttaaagttaaatatttatgaaaaatctagatctgtttgaattaaaatgtaagtagaattggttttagggatggggtcggattttgttttttagtgactacaaaagtcaagcatgttaagtggtaatagccatctggttattttcctgcatttgcgttgagtgtttcaaatggttcattgtttgtgttaataaatactgccctgtgcccttactgttggagaatttttgcacagggtgtcagttcttactaagctgtttggtagtaagcatatatcagcagtctttagactgtcttttgatttagatttacagtaagtggtgtactgttttgttaaaaggaattatgtattatatgcatgtaattaagttattgaacagaagtttgtgataatctgctaccatgaccgtcattttactagaaatttgctttaaaaatggcatcttctaagaagctgttaaattcttcattttaatttgttaattggtatttttaagcctcc

SEQ ID NO: 46453 - DNA, 462 bp, Homo sapiens
ttcgctgatgataaaaatcgtgtttatttgacagcttcttagatcgggtaggaatttctattttttcataaaaatgaaagaaaaggaaagaaagaaacaacacacagtctcggattgccttttttcatgctgcaactttggcactgaagtggacagacagaacagcttcccataatgccagattgcaaaaactgaaatgttttccaggtaccactttcaaaactcagaagcagctgaaagaaaatctgaacaaacaaccgaataagcagtggaagaaatcacaaagtaaggaacaaaatctcaactaatataaaattacctcctctttttggagcagaagaaaatgtagaccatttgacatcgtacctggcataaaccatgggcaagcctgttttccaggtctgggaggctcccagtgacctatgctaaacaagccatcatggagatacttctaaaaaaaaa

SEQ ID NO: 46454 - DNA, 2368 bp, Homo sapiens
  misc_feature (17)..(18): n is a, c, g, or t
  misc_feature (1660)..(1660): n is a, c, g, or t
  misc_feature (1694)..(1695): n is a, c, g, or t
  misc_feature (2362)..(2362): n is a, c, g, or t
cacgaggccgctcccgnngccgccgccgccgccgccgccagaggagcagcagcgcttgtgcaaacggggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaccactttcaaaactcagaagcagctgaaagaaaatctgaacaaacaaccgaataagcagtggaagaaatcacaaacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccgtggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccatagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactgcctgtcatctttacttcagagtgttactgggaacccagttccagccagtgaagctgcctcacagagcacttcagcctcccctgccaacaccacagtctctaccataaagggaagaaatctgcctccagtgccagccttttattcccaaaagcttcaactattctcctaactcatcaanttctgaagtctcttcaacttcagccagcaaggcnncaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccaactccccaagcctggaaatgaagattcacaacttcttacaaggtaatcctggtttcagtggcttaaacttaaacatcccaatcctgagcagtttgggggtccagcgccccatcaagagagccatccctcagtacttccagcgtggcctattagcactcaatcgaaacattgatggaaccccggtaaaggatgaacggatgggaaaccagccaggatgagatgatgacaggccaatcagcaagtagatactaagtcctggagatcaaagaccaatagaccgggtcctcaagaaccaagggacagagtagcaccccgtggagaagaaagacaccgaaagctccaacggatcaaattgaacctggcgggagaatccaaaaagccccggggcgagacaactaccggaaggcacagacgcatcaaagtcaagaaaggcacaaaaggagtgccaccgaggaaaaagatcaagaggccacagcaggcagagacgacgacacgcaccacaaanagcaat

SEQ ID NO: 46455 - DNA, 2492 bp, Homo sapiens
  misc_feature (17)..(18): n is a, c, g, or t
  misc_feature (1784)..(1784): n is a, c, g, or t
  misc_feature (1818)..(1819): n is a, c, g, or t
  misc_feature (2486)..(2486): n is a, c, g, or t
cacgaggccgctcccgnngccgccgccgccgccgccgccagaggagcagcagcgcttgtgcaaacggggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccgtggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccatagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgcctccagtgccagccttttattcccaaaagcttcaactattctcctaactcatcaanttctgaagtctcttcaacttcagccagcaaggcnncaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccaactccccaagcctggaaatgaagattcacaacttcttacaaggtaatcctggtttcagtggcttaaacttaaacatcccaatcctgagcagtttgggggtccagcgccccatcaagagagccatccctcagtacttccagcgtggcctattagcactcaatcgaaacattgatggaaccccggtaaaggatgaacggatgggaaaccagccaggatgagatgatgacaggccaatcagcaagtagatactaagtcctggagatcaaagaccaatagaccgggtcctcaagaaccaagggacagagtagcaccccgtggagaagaaagacaccgaaagctccaacggatcaaattgaacctggcgggagaatccaaaaagccccggggcgagacaactaccggaaggcacagacgcatcaaagtcaagaaaggcacaaaaggagtgccaccgaggaaaaagatcaagaggccacagcaggcagagacgacgacacgcaccacaaanagcaat

SEQ ID NO: 46456 - DNA, 1906 bp, Homo sapiens
  misc_feature (1198)..(1198): n is a, c, g, or t
  misc_feature (1232)..(1233): n is a, c, g, or t
  misc_feature (1900)..(1900): n is a, c, g, or t
tggatccccccaacgtgctcacatctactgagctggcacggaggagagacataagtaaacaaatatataccagtttatctaaacatgctcaacagcctttcttggactcagcatcacctacaatcttcccttcccctttctctagtgggtcgctcccccagtcccccatgtctgttacattttaccacaatcctggcaaatctactttctttctctcccttttgtgagcaggttggccaacctctcacaaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccgtggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccatagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgcctccagtgccagccttttattcccaaaagcttcaactattctcctaactcatcaanttctgaagtctcttcaacttcagccagcaaggcnncaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccaactccccaagcctggaaatgaagattcacaacttcttacaaggtaatcctggtttcagtggcttaaacttaaacatcccaatcctgagcagtttgggggtccagcgccccatcaagagagccatccctcagtacttccagcgtggcctattagcactcaatcgaaacattgatggaaccccggtaaaggatgaacggatgggaaaccagccaggatgagatgatgacaggccaatcagcaagtagatactaagtcctggagatcaaagaccaatagaccgggtcctcaagaaccaagggacagagtagcaccccgtggagaagaaagacaccgaaagctccaacggatcaaattgaacctggcgggagaatccaaaaagccccggggcgagacaactaccggaaggcacagacgcatcaaagtcaagaaaggcacaaaaggagtgccaccgaggaaaaagatcaagaggccacagcaggcagagacgacgacacgcaccacaaanagcaat

SEQ ID NO: 46457 - DNA, 358 bp, Homo sapiens
tcaaaaaataaataaataaatgaagtctataactaaacatggttttgacatgataattgatcattaatatctgtcaccatgagaaaaagtgaaaagtttttttcctcccagggttttgttaagctttagggtgtttgttttgttttgttttgttttgttttacaaaatgaggagagagagaatgagaataattgaatgatcttgtaaatgaaatatgactctggtctgtgtttagtctcaggccctaattgaagagctgttgctatacaagcgctcagaagatcagatagaactgaaggaaaagcagttgtcaactatgagggtggatgtgtgcagcacagaaactctcaaatgctta

SEQ ID NO: 46458 - DNA, 2570 bp, Homo sapiens
  misc_feature (17)..(18): n is a, c, g, or t
  misc_feature (1862)..(1862): n is a, c, g, or t
  misc_feature (1896)..(1897): n is a, c, g, or t
  misc_feature (2564)..(2564): n is a, c, g, or t
cacgaggccgctcccgnngccgccgccgccgccgccgccagaggagcagcagcgcttgtgcaaacggggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaccactttcaaaactcagaagcagctgaaagaaaatctgaacaaacaaccgaataagcagtggaagaaatcacaaacatctacaaatccaaaagctgctctcaagtctaagatagttgctgaatttcgatctcaggccctaattgaagagctgttgctatacaagcgctcagaagatcagatagaactgaaggaaaagcagttgtcaactatgagggtggatgtgtgcagcacagaaactctcaaatgcttaaaagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgcatataaaacctttgctaaccgagtaaacaatttaaagaagaagttggatcaattgaagtcaacccttccagatcctgaagaatcaccagttccttccccaagcatggacgctccctccccgactggttctgagtctccttttcagggaatgggaggtgaggaatcccagtcaccaaccgtggagagtgagaaatctgccacacctgaacctgtgacagataatcgtgatgtggaagacatggaactctcagatgtggaagatgatgggtcaaaaatcattgtcgaggacaggaaggaaaaacctgcagagaagtcagctgtatccacttctgtacctacaaagccatagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggggtcagtcctgcatcaagaccttctccaggaacgcccaccagccccagcaacctcaccagtggcctgaaaacacctgcacctgccacgacaacatctcacaaccctctggcaaatatcctctccaaggtggagatcaccccagagagcattctgtctgcactttccaaaacccagacacagtcagcccctgcactgcaaggcctgtcatctttacttcagagtgttactgggaacccagttccagccagtgaagctgcctcacagagcacttcagcctcccctgccaacaccacagtctctaccataaagggaagaaatctgcctccagtgccagccttttattcccaaaagcttcaactattctcctaactcatcaanttctgaagtctcttcaacttcagccagcaaggcnncaattgggcaaagcccagggctcccaagcactacttttaaactaccttccaactctttggggtttacagctacccacaatactagccctgctgccccacctactgaagttaccatctgccaatcttcagaggtctccaagccaaagctggagtcagagtccaactccccaagcctggaaatgaagattcacaacttcttacaaggtaatcctggtttcagtggcttaaacttaaacatcccaatcctgagcagtttgggggtccagcgccccatcaagagagccatccctcagtacttccagcgtggcctattagcactcaatcgaaacattgatggaaccccggtaaaggatgaacggatgggaaaccagccaggatgagatgatgacaggccaatcagcaagtagatactaagtcctggagatcaaagaccaatagaccgggtcctcaagaaccaagggacagagtagcaccccgtggagaagaaagacaccgaaagctccaacggatcaaattgaacctggcgggagaatccaaaaagccccggggcgagacaactaccggaaggcacagacgcatcaaagtcaagaaaggcacaaaaggagtgccaccgaggaaaaagatcaagaggccacagcaggcagagacgacgacacgcaccacaaanagcaat

SEQ ID NO: 46459 - DNA, 763 bp, Homo sapiens
  misc_feature (17)..(18): n is a, c, g, or t
cacgaggccgctcccgnngccgccgccgccgccgccgccagaggagcagcagcgcttgtgcaaacggggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatctgcatatccccaccgtttgaatctcttttaccttgccaatgatgtcatacagaactgtaaaaggaaaaatgcaatcatattccgtgaatcatttgctgatgtacttcctgaagcagctgctctagtgaaggatccatctgtctctaagtctgtagaacgaatctttaaaatctgggaagatagaaatgtatacccagaagaaatgattgtggcattgagagaagctttgagtaccactttcaaaactcagaagcagctgaaagaaaatctgaacaaacaaccgaataagcagtggaagaaatcacaaagtaaggaacaaaatctcaactaatataaaattacctcctctttttggagcagaagaaaatgtagaccatttgacatcgtacctggcataaaccatgggcaagcctgttttccaggtctgggaggctcccagtgacctatgctaaacaagccatcatggagatacttctaaaaaaaaa

SEQ ID NO: 46460 - DNA, 558 bp, Homo sapiens
gattacaggagtgagctccacttggtgccgtttccatactctgtggggacgagctctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttgctccttccaaatatcagatgctgcactccattgcaaccaagtgggagcgcgatcctctagatcgcccacc

SEQ ID NO: 46461 - DNA, 3174 bp, Homo sapiens
gtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttgttttgcagtttcaaaaattaaagacctacatcacacggttgatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttctcttatgcatctctaaaacccttgatgaaaacatgtaaacttcagtaatggcagtattagaaagttcatgtaggaactaaaagaaaaattgttaagcttgtttcctttatatcatcagttacatatcccactgttctaagctagtttgtacagtatgtgggatcggatatacttagatatttttaaaaatttcattcattaatgctttttttgcaaaatactcaactgggaatccaactggaaattgctgagtatgtcccacctcaaattatttttttatcctttggcaacagcagcatggagcaaggatatgtacaatgatatcagatccttttactcatacctttttgaaaaagatttgggacttttttattctggagtctgtacaggttttcagaggtacttgcctaccttcatcctttccccaggaagttaaattcaaaattgtgactatttcatttactttcctggggaatgggcccatgcctgtaatcaggttttccaagcacttggactgaattgaaccattgctaggtgaccataaatgttttgaatcgactttcaaggaatggaggaggcaggaagttaaaagcatcatttcaactgcgaaaatatgggttatctgtattaaagggaaataacgttttggtattatccaaattacttccccttttgaagatttcctatgtaattacaactgtcagtaatacaagagagcaaatatatttccctggcagctgctaaaatttggaatgctgaacgttggtttaaggagttgctttcacctcctccccacccccgcccgccgcttagttaagcgtttgtatctcctgttccccagtagtagtagtagtactacttggggcttttgaaagggagagaaaatgttaggggaacccaattaataatc

SEQ ID NO: 46462 - DNA, 3120 bp, Homo sapiens
gtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttgttttgcagtttcaaaaattaaagacctacatcacacggttgatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttctcttatgcatctctaaaacccttgatgaaaacatgtaaacttcagtaatggcagtattagaaagttcatgtaggaactaaaagaaaaattgttaagcttgtttcctttatatcatcagttacatatcccactgttctaagctagtttgtacagtatgtgggatcggatatacttagatatttttaaaaatttcattcattaatgctttttttgcttatttttttatcctttggcaacagcagcatggagcaaggatatgtacaatgatatcagatccttttactcatacctttttgaaaaagatttgggacttttttattctggagtctgtacaggttttcagaggtacttgcctaccttcatcctttccccaggaagttaaattcaaaattgtgactatttcatttactttcctggggaatgggcccatgcctgtaatcaggttttccaagcacttggactgaattgaaccattgctaggtgaccataaatgttttgaatcgactttcaaggaatggaggaggcaggaagttaaaagcatcatttcaactgcgaaaatatgggttatctgtattaaagggaaataacgttttggtattatccaaattacttccccttttgaagatttcctatgtaattacaactgtcagtaatacaagagagcaaatatatttccctggcagctgctaaaatttggaatgctgaacgttggtttaaggagttgctttcacctcctccccacccccgcccgccgcttagttaagcgtttgtatctcctgttccccagtagtagtagtagtactacttggggcttttgaaagggagagaaaatgttaggggaacccaattaataatc

SEQ ID NO: 46463 - DNA, 1247 bp, Homo sapiens
gtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcaga

SEQ ID NO: 46464 - DNA, 2533 bp, Homo sapiens
cacgcgtcgcggacgcgtgggaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttgttttgcagtttcaaaaattaaagacctacatcacacggttgatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttctcttatgcatctctaaaacccttgatgaaaacatgtaaacttcagtaatggcagtattagaaagttcatgtaggaactaaaagaaaaattgttaagcttgtttcctttatatcatcagttacatatcccactgttctaagctagtttgtacagtatgtgggatcggatatacttagatatttttaaaaatttcattcattaatgctttttttgcaaaatactcaactgggaatccaactggaaattgctgagtatgtcccacctcaaattatttttttatcctttggcaacagcagcatggagcaaggatatgtacaatgatatcagatccttttactcatacctttttgaaaaagatttgggacttttttattctggagtctgtacaggttttcagaggtacttgcctaccttcatcctttccccaggaagttaaattcaaaattgtgactatttcatttactttcctggggaatgggcccatgcctgtaatcaggttttccaagcacttggactgaattgaaccattgctaggtgaccataaatgttttgaatcgactttcaaggaatggaggaggcaggaagttaaaagcatcatttcaactgcgaaaatatgggttatctgtattaaagggaaataacgttttggtattatccaaattacttccccttttgaagatttcctatgtaattacaactgtcagtaatacaagagagcaaatatatttccctggcagctgctaaaatttggaatgctgaacgttggtttaaggagttgctttcacctcctccccacccccgcccgccgcttagttaagcgtttgtatctcctgttccccagtagtagtagtagtactacttggggcttttgaaagggagagaaaatgttaggggaacccaattaataatc

SEQ ID NO: 46465 - DNA, 2717 bp, Homo sapiens
taagagagagggttttggtctgtcactcaggttggcatgttgcactctacaggcacgtgctactacacccagctaactgttgaatttttttgtagagatggcgtctcattatgctgtccaggcttgtctcagactcctggccacaaatgatctacctgccttggccttccaaagtgctgggattacaggtgtgagtcattgcatcccagccactaatttgtctcattttatttctttcaggaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttgttttgcagtttcaaaaattaaagacctacatcacacggttgatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttctcttatgcatctctaaaacccttgatgaaaacatgtaaacttcagtaatggcagtattagaaagttcatgtaggaactaaaagaaaaattgttaagcttgtttcctttatatcatcagttacatatcccactgttctaagctagtttgtacagtatgtgggatcggatatacttagatatttttaaaaatttcattcattaatgctttttttgcaaaatactcaactgggaatccaactggaaattgctgagtatgtcccacctcaaattatttttttatcctttggcaacagcagcatggagcaaggatatgtacaatgatatcagatccttttactcatacctttttgaaaaagatttgggacttttttattctggagtctgtacaggttttcagaggtacttgcctaccttcatcctttccccaggaagttaaattcaaaattgtgactatttcatttactttcctggggaatgggcccatgcctgtaatcaggttttccaagcacttggactgaattgaaccattgctaggtgaccataaatgttttgaatcgactttcaaggaatggaggaggcaggaagttaaaagcatcatttcaactgcgaaaatatgggttatctgtattaaagggaaataacgttttggtattatccaaattacttccccttttgaagatttcctatgtaattacaactgtcagtaatacaagagagcaaatatatttccctggcagctgctaaaatttggaatgctgaacgttggtttaaggagttgctttcacctcctccccacccccgcccgccgcttagttaagcgtttgtatctcctgttccccagtagtagtagtagtactacttggggcttttgaaagggagagaaaatgttaggggaacccaattaataatc

SEQ ID NO: 46466 - DNA, 1983 bp, Homo sapiens
gtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttgttttgcagtttcaaaaattaaagacctacatcacacggttgatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgt

SEQ ID NO: 46467 - DNA, 297 bp, Homo sapiens
gtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtcttatttttaatttttggataggtgatgtatatttctttttttattattattatactttaaattctagggtccatgtgcacaatgtgcaggttacgtatgtatacatgtgccat

SEQ ID NO: 46468 - DNA, 1687 bp, Homo sapiens
gtggttggctgaggctggcttctgcgtggtgcagctgcgcacgtgtttcagccggcagcgctttaagatttccggggatggaatccgaaatggaaacgcagagcgccagggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcatgagctgtgatcatcccactgcactccagcccagatgaacagaacaagaccctgtctcaaaaaaaagaaaaggagctctgggccttaaatccatctacttgcttaggtctaacaaacctttactcctgggatgttttaacaagtcacagaacccattgtaactagtgcacatctggtgatacaggtgttctggatataaaacatccccaacttatctggcccagggatgtcatttgccagagcatctcaagtgcctattacagtgatggacatgtagtagggactgtaaagttgaataaatgaaagcaaagttaccaagtaaatgtaatctcaagaaat

SEQ ID NO: 46469 - DNA, 2948 bp, Homo sapiens
gattacaggagtgagctccacttggtgccgtttccatactctgtggggacgagctctgagtgggaaagaagaaacaaggaaaattccagtcccagctaacagatacacaccattgaaagaaaactggatgaagatatttactcctattgtggaacatttgggacttcagatacgctttaacttgaaatcaaggaatgtagaaatcaggacttgtaaagaaaccaaggatgttagtgctctgacaaaagcagctgattttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagcctccgtcccttcttccattctcagccagaagcataaacagaaaagaaagatttaagaggattcacactcaacaggttttaggataatttaaatatcaaaaattgattgttatacttacacattaggtataatttatcatttatctgaaatcacatgtagcagattgcatagtctgtaatcctctcagagggaaacttcttgtttaaacagctctatatggatttatacttttatatttataaatttataacttcatacaaatttataaacatttctttataaattgtaatttaatagattatctcagaaaaacctctctgaatgatgacccttccttaatactgggtgatgtgtgaatatttgtttgttggcagacagggtctcactttgtcacccaggctagagtgcagtggtgcaatctcagctcactgcagcctctgcctcctgagttcaagtgatcctcctgcttcagcctccctagtagctgggactacaggtatgcaccaccatgcctggctaattttttgtattttttgtagagatggggtttcgccatgttgaccaggctggtcttgaactcctggcctcaagggatccgtccgcctcagcctcccaaagtgctgggattacaggcataagccactgcgcctggccttgatgtgtgaatatttgagaggtcataagcagtggttttggccataccgtattataccatatacatcagtaagagctcatcttggaacctgttgttttgcagtttcaaaaattaaagacctacatcacacggttgatgtgaagaaagctttatttttcaaatgagtatttaatgaaagtatacataaccaatgttgggtatacagatgcttctcaacttatgatgggtttaggtccagataagcccactgtgagttgaaaataccaaaagtcaaacatcatagcttagcctaccttaaaagggctccgaacactacattagcctacagttgggcaaaatcgtctaatacaaagcctattttataataaagtatgttgaatatctcatgtaatttttgaagattacattgaaagtgaaaaacagaatggttgggtacttgaaatacagcttctactgaatgaataattctaaagttgaaaaataatagtaagaaccatcataagtctgtttcttctagtaaaggtgaaatgatgaaagaatgcttttttcccacccaaaaaactatgctctataaatgcagattagctagtttctgcctgtttaaatggtattattttatacattacaaaatggaaggaacttactttattaaacttaactttgatacttctcttatgcatctctaaaacccttgatgaaaacatgtaaacttcagtaatggcagtattagaaagttcatgtaggaactaaaagaaaaattgttaagcttgtttcctttatatcatcagttacatatcccactgttctaagctagtttgtacagtatgtgggatcggatatacttagatatttttaaaaatttcattcattaatgctttttttgcaaaatactcaactgggaatccaactggaaattgctgagtatgtcccacctcaaattatttttttatcctttggcaacagcagcatggagcaaggatatgtacaatgatatcagatccttttactcatacctttttgaaaaagatttgggacttttttattctggagtctgtacaggttttcagaggtacttgcctaccttcatcctttccccaggaagttaaattcaaaattgtgactatttcatttactttcctggggaatgggcccatgcctgtaatcaggttttccaagcacttggactgaattgaaccattgctaggtgaccataaatgttttgaatcgactttcaaggaatggaggaggcaggaagttaaaagcatcatttcaactgcgaaaatatgggttatctgtattaaagggaaataacgttttggtattatccaaattacttccccttttgaagatttcctatgtaattacaactgtcagtaatacaagagagcaaatatatttccctggcagctgctaaaatttggaatgctgaacgttggtttaaggagttgctttcacctcctccccacccccgcccgccgcttagttaagcgtttgtatctcctgttccccagtagtagtagtagtactacttggggcttttgaaagggagagaaaatgttaggggaacccaattaataatc

SEQ ID NO: 46470 - DNA, 389 bp, Homo sapiens
tttgtagagatggggtttcaccatgttgtccaggctggtctcgaacttgtgagctcaagtaatcggtccacctcagcctcccaaagtgctgggattacaggcatgagccaccgtgcctggccaaaaagatctttacactgcaagaatgactgcctctacattgcctcttgctgaatgcctaatttattgattttgccaaaatatataaaccttactgaattatgacagggtattgggttctcgctaatgcttattatagaaattctctggcataatcaaccttttactagtactcatgaacaggagtatgtaatcatgggactatgaaaactgaatattttctgagctttctcataaatttacttggggatctgacccaagtggtcttt

SEQ ID NO: 46471 - DNA, 2467 bp, Homo sapiens
  misc_feature (1513)..(1513): n is a, c, g, or t
  misc_feature (2342)..(2342): n is a, c, g, or t
caaacagctgctaaaaagagaatgctgcgctgcgggccagcccacgtgaccgggaggaaggctctcccgcccatgaattcggctcgaggggaaaactatgcctggggccgacgctctgcccggctgctgccgctgaggaaagccgggacgcggagccccgccgagagcttctttgctccggacgcccctggacgtggcgggcagccgcgagggtaaccaccatgatcccctgggtgctcctggcctgtgccctcccctgtgctgctgacccactgcttggcgcctttgctcgcagggacttccggaaaggctcccctcaactggtctgcagcctgcctggcccccagggcccacccggccccccaggagccccagggccctcaggaatgatgggacgaatgggctttcctggcaaagacggccaagatggacacgacggcgaccggggggacagcggagaggaaggtccacctggccggacaggtaaccggggaaagccaggaccaaagggcaaagccggggccattgggcgggctggcccccgtggccccaagggggtcaacggtacccccgggaagcatggcacaccaggcaagaaggggcccaagggcaagaagggggagccaggcctcccaggcccctgcagctgtggcagtggccataccaagtcagctttctcggtggcagtgaccaagagctacccacgggagcggctgcccatcaagtttgacaagattctgatgaacgagggtggccactacaatgcttccagcggcaagttcgtctgcggcgtgcctgggatctactacttcacctacgacatcacgctggccaacaagcacctggccatcggcctggtgcacaacggccagtaccgcatccggacctttgatgccaacaccggcaaccacgatgtggcctcaggctccaccatcctggctctcaagcagggtgacgaagtttggctgcagatcttctactcagagcagaacgggctcttctatgacccttactggacagacagcctctttacgggcttcctaatctatgccgaccaggatgaccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatccaaccatctatttattcacttctttttaaagtatctactgtgtaacaggcactatgctattctctgaaagatgcagcagtggacaagacagagtatctgtcctcatgcagcttacattctagcaggagatacaatttacaaatatacaagcaaataatataatattatgccaggatagaaatgaacatgccatggttgacagtaataggaataacaggagacagggaagaggtggaaatttgtttctttttttaagtttgngtttttaggtttacttacatacagtgactctccagattttaagttgacaactcagtgaataatttttgcttatgtgcacactctgaaacctccatgtagatcaaagaacaagctatttccaacttctcacctcccttccccaaaagctctcttaagacccctctaagtcagtacctggaaaatttccatttttgagctgagttccaaagaaggaaatagagcaacacaaaggcctcgaaaagaggtctccagcaaaaggctctgcaagtgcaaagaccttgacaggaaagagggaggggccaaggtaagaactgagaagggaggcatgaggcgtgaggctggaagataatacagaatgtcccaggccatggcagagctcgttccattcacgaaggcttatcagaatacaaagtgacactgataggcggatcatcttgaatctgctcattgcatgagtcaagtcggccacagacttgagcgctttattattagttaatcttttgcaggcccgcttctcaatgaatgagatacaccaggatatgcacgtgcatctgagaaccgctgctctgagatggcaggaatggatcccacgcaaatgaatcgcaccccaagcacaggtgttgccagtatgcagggatctgggggcttaagaagctgcagtaaaagtgccaggtgctggcgggatgtggtagctcatgcctataatcccaggactttgggaagctgaggtggacggatcatttgaggtcaggagttcaagaccagcctgaccaacatggcaaaacatcgtctaaaaaaatacaaaaattagacaggcgtggtgttgggngcctgtaatcccagctactggggaggctgaggcgggagaatcgcttgaacccaggaggtggaggttgcagttagctgagatcctgccactgcactccagcctgggcaacagagtgagactatctc

SEQ ID NO: 46472 - DNA, 2260 bp, Homo sapiens
  misc_feature (1306)..(1306): n is a, c, g, or t
  misc_feature (2135)..(2135): n is a, c, g, or t
caaacagctgctaaaaagagaatgctgcgctgcgggccagcccacgtgaccgggaggaaggctctcccgcccatgaattcggctcgaggggaaaactatgcctggggccgacgctctgcccggctgctgccgctgaggaaagccgggacgcggagccccgccgagagcttctttgctccggacgcccctggacgtggcgggcagccgcgagggtaaccaccatgatcccctgggtgctcctggcctgtgccctcccctgtgctgctgacccactgcttggcgcctttgctcgcagggacttccggaaaggctcccctcaactggtctgcagcctgcctggcccccagggcccacccggccccccaggagccccagggccctcaggaatgatgggacgaatgggctttcctggcaaagacggccaagatggacacgacggcgaccggggggacagcggagaggaagctttctcggtggcagtgaccaagagctacccacgggagcggctgcccatcaagtttgacaagattctgatgaacgagggtggccactacaatgcttccagcggcaagttcgtctgcggcgtgcctgggatctactacttcacctacgacatcacgctggccaacaagcacctggccatcggcctggtgcacaacggccagtaccgcatccggacctttgatgccaacaccggcaaccacgatgtggcctcaggctccaccatcctggctctcaagcagggtgacgaagtttggctgcagatcttctactcagagcagaacgggctcttctatgacccttactggacagacagcctctttacgggcttcctaatctatgccgaccaggatgaccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatccaaccatctatttattcacttctttttaaagtatctactgtgtaacaggcactatgctattctctgaaagatgcagcagtggacaagacagagtatctgtcctcatgcagcttacattctagcaggagatacaatttacaaatatacaagcaaataatataatattatgccaggatagaaatgaacatgccatggttgacagtaataggaataacaggagacagggaagaggtggaaatttgtttctttttttaagtttgngtttttaggtttacttacatacagtgactctccagattttaagttgacaactcagtgaataatttttgcttatgtgcacactctgaaacctccatgtagatcaaagaacaagctatttccaacttctcacctcccttccccaaaagctctcttaagacccctctaagtcagtacctggaaaatttccatttttgagctgagttccaaagaaggaaatagagcaacacaaaggcctcgaaaagaggtctccagcaaaaggctctgcaagtgcaaagaccttgacaggaaagagggaggggccaaggtaagaactgagaagggaggcatgaggcgtgaggctggaagataatacagaatgtcccaggccatggcagagctcgttccattcacgaaggcttatcagaatacaaagtgacactgataggcggatcatcttgaatctgctcattgcatgagtcaagtcggccacagacttgagcgctttattattagttaatcttttgcaggcccgcttctcaatgaatgagatacaccaggatatgcacgtgcatctgagaaccgctgctctgagatggcaggaatggatcccacgcaaatgaatcgcaccccaagcacaggtgttgccagtatgcagggatctgggggcttaagaagctgcagtaaaagtgccaggtgctggcgggatgtggtagctcatgcctataatcccaggactttgggaagctgaggtggacggatcatttgaggtcaggagttcaagaccagcctgaccaacatggcaaaacatcgtctaaaaaaatacaaaaattagacaggcgtggtgttgggngcctgtaatcccagctactggggaggctgaggcgggagaatcgcttgaacccaggaggtggaggttgcagttagctgagatcctgccactgcactccagcctgggcaacagagtgagactatctc

SEQ ID NO: 46473 - DNA, 2255 bp, Homo sapiens
  misc_feature (1301)..(1301): n is a, c, g, or t
  misc_feature (2130)..(2130): n is a, c, g, or t
caaacagctgctaaaaagagaatgctgcgctgcgggccagcccacgtgaccgggaggaaggctctcccgcccatgaattcggctcgaggggaaaactatgcctggggccgacgctctgcccggctgctgccgctgaggaaagccgggacgcggagccccgccgagagcttctttgctccggacgcccctggacgtggcgggcagccgcgagggtaaccaccatgatcccctgggtgctcctggcctgtgccctcccctgtgctgctgacccactgcttggcgcctttgctcgcagggccctcaggaatgatgggacgaatgggctttcctggcaaagacggccaagatggacacgacgccgggaagcatggcacaccaggcaagaaggggcccaagggcaagaagggggagccaggcctcccaggcccctgcagctgtggcagtggccataccaagtcagctttctcggtggcagtgaccaagagctacccacgggagcggctgcccatcaagtttgacaagattctgatgaacgagggtggccactacaatgcttccagcggcaagttcgtctgcggcgtgcctgggatctactacttcacctacgacatcacgctggccaacaagcacctggccatcggcctggtgcacaacggccagtaccgcatccggacctttgatgccaacaccggcaaccacgatgtggcctcaggctccaccatcctggctctcaagcagggtgacgaagtttggctgcagatcttctactcagagcagaacgggctcttctatgacccttactggacagacagcctctttacgggcttcctaatctatgccgaccaggatgaccccaacgaggtatagacatgccacggcggtcctccaggcagggaacaagcttctggacttgggcttacagagcaagaccccacaactgtaggctgggggtggggggtcgagtgagcggttctagcctcaggctcacctcctctgcctctttttttccccttcattaaatccaaacctttttattcatccaaccatctatttattcacttctttttaaagtatctactgtgtaacaggcactatgctattctctgaaagatgcagcagtggacaagacagagtatctgtcctcatgcagcttacattctagcaggagatacaatttacaaatatacaagcaaataatataatattatgccaggatagaaatgaacatgccatggttgacagtaataggaataacaggagacagggaagaggtggaaatttgtttctttttttaagtttgngtttttaggtttacttacatacagtgactctccagattttaagttgacaactcagtgaataatttttgcttatgtgcacactctgaaacctccatgtagatcaaagaacaagctatttccaacttctcacctcccttccccaaaagctctcttaagacccctctaagtcagtacctggaaaatttccatttttgagctgagttccaaagaaggaaatagagcaacacaaaggcctcgaaaagaggtctccagcaaaaggctctgcaagtgcaaagaccttgacaggaaagagggaggggccaaggtaagaactgagaagggaggcatgaggcgtgaggctggaagataatacagaatgtcccaggccatggcagagctcgttccattcacgaaggcttatcagaatacaaagtgacactgataggcggatcatcttgaatctgctcattgcatgagtcaagtcggccacagacttgagcgctttattattagttaatcttttgcaggcccgcttctcaatgaatgagatacaccaggatatgcacgtgcatctgagaaccgctgctctgagatggcaggaatggatcccacgcaaatgaatcgcaccccaagcacaggtgttgccagtatgcagggatctgggggcttaagaagctgcagtaaaagtgccaggtgctggcgggatgtggtagctcatgcctataatcccaggactttgggaagctgaggtggacggatcatttgaggtcaggagttcaagaccagcctgaccaacatggcaaaacatcgtctaaaaaaatacaaaaattagacaggcgtggtgttgggngcctgtaatcccagctactggggaggctgaggcgggagaatcgcttgaacccaggaggtggaggttgcagttagctgagatcctgccactgcactccagcctgggcaacagagtgagactatctc

SEQ ID NO: 46474 - DNA, 1882 bp, Homo sapiens
cgaactcatgctggagagaaatcttacaatgtcatgattgtggcaaggtcttcagtcaagcttcatcttttgcaaaacaggagaattcatacaggagagaaacctcacaagtgtgatgatcgtggcaaagcctttacttcacattctcacctcattagacatcagagaatccatactggacagaaatcttacaaatgtcatcagtgtggcaaggtcttcagtccgacttcactccttgcagaatatcagaaaattcatttttcaggatttctatgatgactggattttgaattttgtggaacgctttttctccatctactaaggtgatgtggttttaatctttcattctgttctagtggtatataacattgatttgcttgaatatgttgaaccatccttgcatcccagaaataactggcacttgaatatctacatttttttaatatcctcttgaatacagttttctaggacaagggatcttcaagaagttctggaaaaatacatattatgagaaaatgtgcatgaatttcacaatttttgcaccaaaataaactagtgctagtctgttataacatgtctgaacaggctctagtttgatgccctcaaaaggataagacatgagtataaaaagagactccatcaaagcaatataaattctgatgaaatttaaacaagaagaaacattaaatttatgatgagaccagatgcagtggctcaggcctgtaatcccagcattttcagaggctgagacaggtgggccacatgagcccaggtattcaagaccagcctgggaaacgtggggaaatccccttttctacaaaaaatacaaaaattagctgggcatggtggcacatgcctgccgtctcagttattgtgaagtctgtgcagggaggatggcatgaacctgggaggtcaagattgcagtgagctatgatcatgccactgcactccagcatgggtgatggagagagatactgtcttaaaaaaagaatacttgtggtaacgtttgggtagaggaataatgaaatcattgatgctttataaaaaggttatggggacaatgcccaaaagaaataaacagtttgtaaacggataacttattttgagttagggcaagacaatgttgacagtgatgcatgaagcagcaggcagaccttccacatcatttttacagaaaaaaaaattaatcttgttcatgctgcaatgaagaggactgacagcaaacagcagaaacatagtcagaatttagagaacagcctggttaacatggtgaaacaccatctctagtaaaaatacaaaaattagctcagcatggtggcatgcgcctgtaatcccagctactcaggaggctgaggcaggggaatctcttgaacccaggaggtggaggatgcagtgaactgagatggcaacattacactctagcctgagcaacaagagcaaaactccatctcaaaaaaaaaaaaaaattgtcaagttccttctcttccattctttgccatcgtggtgtgtgcttgactctgcttcttgccacatcttctcagaagactttcaggattaagcgattcctggccaagaaacaaaagcaaaaccatcccactcccctgtggattcagatcaaaactggtaataaaatcaggtacgactccaaaaggagacattggagaagaaccaagctgggtctataaggaattgcatgtgagatggcacacatatttatgctgtctgagcatcacaatcacgttaccatatcaagctgaaaatgtcaccactatctggacagttggacatgttttattgggaatatgttttttctctgtaaatttgttataaacgcattggttggctgtgttcagtaataaacgtgagacttttcatttcaaaa

SEQ ID NO: 46475 - DNA, 239 bp, Homo sapiens
actcatttgtcatttcatggatgttctttctattgttgaggtaaatttccttttctattttgtttaggatttctatgatgactggattttgaattttgtggaacgctttttctccatctactaaggtgatgtggttttaatctttcattctgttctagtggtatataacattgatttgcttgaatatgttgaaccatccttgcatcccagaaataactggcacttgaatatctacattt

SEQ ID NO: 46476 - DNA, 1544 bp, Homo sapiens
atcagaaagaagcaggcgaagaaagctgcagcgatcagagcaaaaaagagctctaaagtcagagcaagccaagaacttgagatgtctctgaagcctgaggaaccaggaaaacccgtagtcgccacattttctgagagccggatattggaaaagcaagataaacgagccagctaagcctgtggaacatgcctcatacctggagtcgccattatccctggaattacaaagatctgcaaaatttatagcgctcacagaaaccctggaggctgtaataaacctggagccccctggactctcctcagctcacaaaaccctctcaattcctacacatcccttaacactcattctccattgaataggtggttactcttagacctagtcttagaacctctgaagacacactttgtaatttgttgtttggctaaatgagaagaaatctgtgccaccctgggaaggtgtcaaaagaaggaaaaatacatgtgacaatatgaatcaagtccatcagcaagttacttttgagcgcctactgtgtgtcagtgcctgagatacacctacaagagcgccaggctttcaagccttcatatctggatagaatcccaacttcagtgcttggtggctgtctatctttggacaagatctttcattccccatcctttgaacatcacatgacccatatctgggtggagaatgggtgaaaagtactgttcagagatgcaggtgagaaaaaacatgacgatgggccctgaatgccaagattcattggagctttggagctttatcttgtaggaccttatcctgactcccttagaatgtaagttccaagagaacagggactttgtctgccttgttttctacttttatcaccagcacccagaatgatgcctaaaatacaataagatctcaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcgcccctactccccccgggggggcaccgaccgtaattgacctaccccaccgtattttttgtcagaaaagaggggcggcccccattatagggggggcgtatatataatatatacaaccacaaagagcgacggcggccgcgctatataaacaaccacacgcgttttgcagtggagcgaaaaaacaacctgcgcataagagggcgagcatactatggatcgaagagagaacacaccctcaactctcggtagcgggggcggggcgacacgaaaacacagaatggagcgcggaacgcacccaacgcaccccccgaccataacaatagataaataaaaaagaccacaactcggacagaaatacatatacatacatactctccataccatgcgtgcatacatcgaggtgaggtacccaaaccaacacgcccgtctctaatatattgatcccggcaggagggtaaaagaaaatatttaggtcatacctgcgtgcgtcattatattattaataaacatctttattctcgaccagaacggaaa

SEQ ID NO: 46477 - DNA, 354 bp, Homo sapiens
tccatagtctggctttgcctccagtgtcagcccttccctggtgtgccccagggcagctctccccactggtggtccatttaaaagtaggtgccctggagggctcacccctcaggccctggccagctcacacctcagttgtcacttggtttcaccaagggaattcctcgaagacagctgtgagcaaggtgggggctgcgccaggagagagaataggagcaggcaagtgggtagacctttcccactgtgctccttcagacggctgggccctggctcctccctccagggtcggcttcctcccctgacacagctggtgagctgggccgtgcagcaggtggagcaggtgtggcccaggcc

SEQ ID NO: 46478 - DNA, 460 bp, Homo sapiens
aggagcaaatcacaagggtggaatgtcatcagttaaggcaggaaccggccattttcacttcttttgtggttcttcagttgcctcaggccatctggatgtattcgtgcaggcctgggctcagaggcctgacagaaacatgcacccagaggcgggagctaacatcagcgaaagcccatacctctctcaacaagattccagttcctccctgttggccacctccttctgggggcttctgctctgtatcccattggttgtgtgacatcatcagcttcctctaaaaattgcaaaggacacagaatcattttgcctcagagctgggctgcatgagatttagtactgcagacagctctctgtatgtgtgggttctgcatctggggattcaaccaacctcggatagaaaatattcaggaaaaaattgtactgaacatgtacagagcttttggttattatttcctgaaca

SEQ ID NO: 46479 - DNA, 3579 bp, Homo sapiens
  misc_feature (758)..(758): n is a, c, g, or t
  misc_feature (768)..(768): n is a, c, g, or t
  misc_feature (1651)..(1651): n is a, c, g, or t
  misc_feature (1768)..(1768): n is a, c, g, or t
  misc_feature (3162)..(3162): n is a, c, g, or t
gaaaacttgtccctaagggactttgtggtcacagcagttctgatttccttgtttgaaatttttgtaaactttccaacttctttgttttgcactcagtacttaaaaataaatttaatgccagaagtaaaagtactattattttcatcaatcataagttatagataacaaaaactcagaaatttttcttgaacataggtagggaacttaggtgaaaggactgctttaattccatctaaaagataaaacctaatactgacttacaaatatgttgctaagagtttagtgtctccaagtaaaggtagaaattttacattatctatcaatgatatcggcgaaaactaaaattattaggaagtaagctaagaataatttatagtctagatttttaacttaaaagtggaaccaatttccaatggtttcttcccttagttcttgagttagccatactgtgaccattaaaaaacatctttaaaatgtatgtgaaaaaacctgaagaaaatgtggcaaagggtaagatttgataagaaatgggtctaggtttatagggaatgcattatagtctttatagttatgtgtgtttgaaatataataaaacacttttagatgaattctttcttttttttttttttcctttttgagacacagtctcactctgttgcccaggctggagtgcagtggtgtgatcttggctcactgcaacctccacctcctgggttcaagtgatgcatgtgcctcagcctctggagtagctgggattncaggcgcacnccaccacaccagctaatttttgtatttttagtaggagacggggtttcaccatggctggtgttgaactcctgacctcaagtgatacgcccacctcggcctctcaaagtgctgggattacaggtgtgagccacaacgcctggctagatgaattatttcctttagaaattattttctgtgtatctgcaaaagtgtttcattttagtactgtgaaatgaataggccctatgctgggtcctgttggggtttgtgatttatagatggtaaaatacatttcacacttacaagatgaagcaatctacctctatataaagagcttgcctgtgggtggttgtagcaagtgtcttcttattatttcacaattgagggcaagagagaggtcagaccattggtgaaacccttagtgcaagcaagtccgcaaataagctttttagctacttaagcctaggtgttttattggcattgaaggccaagacacacgagcaatacttgcacaatcaaaagttctatttttccaagacatgctggtcacacaagaaaaactgagataacatataatttatttttccaagacatgctgatcacaaaagaaaaactgagataacgtataatttagttactgtgtatccactttggatccagattgcatatctatatctgtctgtaaacagacatatgcacacatatatatacctgtgtgtatgtatatatgcacacacacacatatatatttaaaatcacagtacttaattaatttgcctccaaaactaatggccacattaatgcctttgagctaagttagactggctggaatcagttggcaagatcctggtaaatggttttggtgtcaactaggacacaagccaggtgtggtggctcatgcctntaatccttgcactttgggaggctgaggcgggaggatcacttgaggctaggagtttgagaccagtctgtgcaacatagactccatctacaaaaaataaaaaattagccaggtgtggtngcatgtgcctacagtcctagctatttgggaggctgaggcaggaggataccttgagcccaggaggttgaggctgcagtgagccacgatggtaccactgcactccagcctgagcaacagcgagaccctgtccagcagggtagagtgcaaaggatgcctgtggaatgggagaatctgttcagcatccatcctcctgcttccaggctaaacccatgagaagagtgctgtcaacaaaagaagtgttccctacagtggggaagaattgaggttagcagaaagggtaaaacaagaacaaagtaattcctagccatccgaagaggtggaatgggaaaggcaacacctataacaggaaggaaatactccatctggggctgagcctgtcttattctgaggcccaagcttggctgcctttctcttcattccctctgtgtgccacttaacagtatgcatttcaactttcttttcagggaggggccagatgtagaaatgcctcacactacagtggaggagacctcaccagctacctgtaccagtaagatgggattagctcaggaaacgttgttgtttgtttgagggacaagaataacatgaaagaaggagcaagattaacagaacagctgacctagagctgctaggcactggatggtcctctgtgcttatatacacaatgtaatacttgtaaggaaaaagcaaaaggcttggaggaggctgtggactacctatagttgacagtattttcctttgtgggggtggtggatgtgggacgtagaatgtaaacttcctaccttatacattgatgttacttcattgattatagtgaacactttatagactgaaacaagtctaagaaaaattcatcttgagctgaggagatagagatgacctgccaaagatttcacatccacaaagtttgtatgactgatagttttaataaaaaaaatttgtcagccaaaacatactgagagtttcttagtcgtattaactgatctgaaactgttgccactaggggatataaaagatactacctgtattttagtgataaaccacaaagaataaaatgagtttttaattagcatcatgcagccacttaagtattagcaaagaaaatttgtagctgatctttcagttctctgtaatatagaaaaacagatgctgcatctctagttttgcctgtgcctgggggatatttaaaacttgtactaaaatgttaatttcgccatggtagaggtgacggggaaacttgcaaaaaaaggggaaagaggagggaattgggtgcatagaagtgagcatgaggccagcagtagggaatgagtttacaataaataaggtgtgagagtggttggggggagtgggagaggtttgggggctgggaagacaagggaaaagaaaatgcaggnatatgctatttgtgttcattttgtctttgaaaatcgtaagtgtacagcatcattctcgggcagagtctgggaggacttgagttgactgctacagtttatgatcttccctaaacatcgacgttcctggaaatctttggcctctgagctgacttcttctctgttgcttgtgagccaggaatttaacagctctgttgtatgtgcaggctgcagatgcttctcttcagcttttgctatccaatgtgtgtgtgtgtgtgtgtgtgtgtgtgtgtgtgtgtgtgtgtgtgtgtgtgttggataaacttaaaaaacctgttgcttccatgcaacggcccacacaacttgggactcatggtcagcctcaccttccacattggctaaaactctacaggaaacagtttatggagtttaaggaaaaaa

SEQ ID NO: 46480 - DNA, 618 bp, Homo sapiens
gtacttagtaagcatgcttctaattgtggttcccttccacttacctttgtgataggggtaccaaaatctgtttaccctcatctttgctctcttccagaggaacaggagaggtagttgggtcagtgtgccagaaaagcagaagttgagtatgtggagttcatagctgcatgtatgagtgtttgtggggcagggaacttttaatggaaaacatttgtgttgcatcgaaaacagagcgaggcctggttagagtctgtctgctttgtctgtcagtctgttccctaccagcactagtcactgttctcctgggagtctcaggcatattgtggtttccttcctgctcttgctagcccctaatcttgccagagtttttgtgtcatgggtggccccgtgtgcagtctggagtaagactgcaaggttggtgactaatggctttgaagaaggtacttcagcccacatacggactttgggaacctttttaggttaacccttaggaggagggagggtctctagcacaaacagtggaagaaacattgctgggattacaggcgtgaaccacggcacccggcctgagctctatctaatctgagtgcccctgaaattgacatttgttcattattt

SEQ ID NO: 46481 - DNA, 816 bp, Homo sapiens
gtacttagtaagcatgcttctaattgtggttcccttccacttacctttgtgataggggtaccaaaatctgtttaccctcatctttgctctcttccagaggaacaggagaggtagttgggtcagtgtgccagaaaagcagaagttgagtatgtggagttcatagctgcatgtatgagtgtttgtggggcagggaacttttaatggaaaacatttgtgttgcatcgaaaacagagcgaggcctggttagagtctgtctgctttgtctgtcagtctgttccctaccagcactagtcactgttctcctgggagtctcaggcatattgtggtttccttcctgctcttgctagcccctaatcttgccagagtttttgtgtcatgggtggccccgtgtgcagtctggagtaagactgcaaggttggtgactaatggctttgaagaaggtacttcagcccacatacggactttgggaacctttttaggttaacccttaggaggagggagggtctctagcacaaacagtggaagaaacatgctgagatacatacaaacacttttttaaacccttcccttactgttagcaaagcatgaactagaagaatggagacacacccggtgacaccatgcctgtaatcccagcactttgggaagctaaagcgggaggatcgctcgagcccaggatggtctcgaactcctgacctcaaatgatctgcccacctcagcttcccgaagtgctgggattacaggcgtgaaccacggcacccggcctgagctctatctaatctgagtgcccctgaaattgacatttgttcattattt

SEQ ID NO: 46482 - DNA, 603 bp, Homo sapiens
aaagaagaagaccgacatgaatacttgactcctgtagcttctggtatcctcatcctcccagatcctgacattaggctgaacatctgtgctggatttagaggtggtgtattctcaccttttaagtaatggatattttagtgaaaaggtggtatcagggcctgctgtctagatgccatttttaggaagaagtgtcagaaagtttttaagactgcaaggaaagagaacactctcagggggttgataccaacaggggtggaagtcaaaatgaggacaaagtgaggccctgagcgtcagagatcaaggccaagagggcatagcagagggaatccagttccagacaggcttgcagtgctatggagatataaagttcaagaacacaacatgcgtgctttcgaggagcgtatcattattcaggaagtcaagacaccagtgaatgaaaagaaaactcactttctgcaatagcgcaaaagagcagtgaagatggtgctcagatgaactgtaagtgttcagatgagggaaaccatggaagacatcatggaggagatttcttctgttcctggtagaattgtgagatgctgcatctgcgttccagctttcaagaat

SEQ ID NO: 46483 - DNA, 177 bp, Homo sapiens
agataattctaatagggtgttatttctggttttctgattatattggatgtgaactaaagcatgtgtttgcatatcatgatctcagaacactctaggacttagtagtacaaaagatcctcaccattactacctaacaattctgtaagtttatatcactgctgggaaaaagaagaaaaa

SEQ ID NO: 46484 - DNA, 574 bp, Homo sapiens
atatctatttaagaaatagcatttttggaattctgtgtgcaattgacttgtcatctatgactttcttatccccaaccagtatctgaggtaacccacaattaaaatacatatatgcatgtatattatcaggtaaaggtaaaagagatcaaaagctaaggataaaatgcttaactgtactcagacactaaattcagcactgagttttctgacatccaaagataagagggaaacaaaagaagttacaaagctttctatttctgataagagaaaaaaatagtatttttcttattgtccttatacatacataataatacatatatatgtccttatgtgtacctatatataacatactattatatacattaagtattataatgcccaactcatccttatacatacctaaaataaaaccacaaattctaaaaattaatcttagctggacatggtggttcccacttgtagctgtagcagctaaggaagctgaggcaggagaatcgcttgagcccaggttacagtgaactgtgatcacagcactgcactccagcctgtgcaacagagcaagaccctgtctctt

SEQ ID NO: 46485 - DNA, 398 bp, Homo sapiens
ggttttaccatcttggccaggctggtcttgaactcctgaccttgtgatccacccgcctcggcctcccaaagtgctggaattacaggcaggagccactgtgcctggcacaagcctagttttttagatgttttgaatgctaccatctccattattcacttttttttttttttttttagacggagtctcgctctgtcacccaggctggagtgcagaggcgtgatctcagctcactgcaacatctgcctcctggattcaagcgattctcctgcctcagcctcccaagtagctgggattacaggcacccgccaccatgcatggctaatttttgtatttttagtaaagacagtttccccatgttggctaggctggtcttgaactcctgacctcaggtgatctgc

SEQ ID NO: 46486 - DNA, 723 bp, Homo sapiens
cagaagaacttccgtaagatgccaaggaaaactgcttttattaaatatcttaatttttggcagaatcattttgtctgatataatgtgatgggtttagtaccacattacatttcacatgttatattctgaaatctgaaactttttttttttaatctaggaatattccctgggcttttgaggcaataaagcaagcaagtgaatgggtaagaagaactgaaggacagtacccatctatctgcccacggcttgaactggggaacgactgggactctgccaccaagcagttgctgggactccagcccataagcactgtgtcccctcttcatagagtcctccattacagtcaaggctaagtcaaatgaaactgaattttaaactttttgcatgcttctatgtagaaaataatcaaatgataatagatacttataatgaaacttcattaaggttttattcagtgtagcaattagtgtcttcaaaaataaagtaagtggaagcagaattactttaatcaactaacaagcaataataaaatgaaacaaaatatttgttttctgtgtctcatttttttgttgtattttttatattttttatattttgagacaaacttttgctcttgttgcccagactggagtgcaatgacatgatctcacctcactgcaatctccgcctcctgggtgcaagcaattctcctccctcagcctcccgagtagctgggattacagg

SEQ ID NO: 46487 - DNA, 409 bp, Homo sapiens
gagagagctagcaccatgagttcaataccctggggtgagtcttggggaacataatcatatctctgatggtcaccatcaggacatgagaccaacagggcaggtctaacacttctggggcctgaacacaactgatgtcaaaatgaaccaactggacaggtgtcctctgtgtagggcaggcacagtccatcaagattctcctagaactgtccagaaccacccccctcccttcactctggttccacacttaatgaaaaaccttctgatgactaatacagggtgctggcacataaatgaagtgttttgaatagcagaaatgggctaggcatagtggctcacgtctgtaatcctagcattttcgggaggctgaggcaggcggattcgtttgagcccagggagttcaaaaccagtg

SEQ ID NO: 46488 - DNA, 791 bp, Homo sapiens
caaccactggcaaataggtattttgtcatcctatttgacagctaaggaagaagagatggaagggctgacttcattcattcttccacttactcccctcagaaaacatgcatttggctcctcgtgtgcacccagcacagttccagggctggagatgccactggcagcaaggccatcatctctgcccctcagggagcaaatggcacatgcagctggggtttgcatctggtctgcctggctccaaagcactgaaaccaaacactaaatgggcgatttaatgagaaacctgggagatgtcaccctgggagagaagaaaatagcattgcatcttaattaattttctccctgatctgagaatcgccatgattaactttagaattaggaacgaactcagaaagcaagcactgggttttcacaatagaaatatgtttttgaacattctaataatcaccacaaaagttattctccatgagtttactgaaaaaaatcaattataagaaattgaccatgtatagttttaagtgtttttcaatgtctaactcctagtcaaggattataccataaggatgggtttaatcataaaagccaaccatattccagtgaaagtcatcaaagaaaacataaaatctgtctggagcagattcagggacaaacattaatcagtaactcaaaacagtgattaaggtgcatttttctgaagctttattttttctgaacaagctgtttatcttgatttatgttaaaatgtgtagcaaacctggtcgtatcaaaataaaataagcctaatcatggga

SEQ ID NO: 46489 - DNA, 1327 bp, Homo sapiens
caaccactggcaaataggtattttgtcatcctatttgacagctaaggaagaagagatggaagggctgacttcattcattcttccacttactcccctcagaaaacatgcatttggctcctcgtgtgcacccagcacagttccagggctggagatgccactggcagcaaggccatcatctctgcccctcagggagcaaatggcacatgcagctggggtttgcatctggtctgcctggctccaaagcactgaaaccaaacactaaatgggcgatttaatgagaaacctgggagatgtcaccctgggagagaagaaaatagcattgcatcttaattaattttctccctgatctgagaatcgccatgattaactttagaattaggaacgactccgattaaaataatgagtgctcctgcgcatccttttgtgatgacaggtgaacacagaaggcattcagttaaccagatttagaaacaagagcctgtggttttgctgcttcaccagaaatcatcttaccgaccaccatgcttacacaaaacaaatggagaaagaagtattaccagttttcatccagagcataagagataagagccatcaagattactagagctagatggaatggcaaagacaggaccctagcaaaatacttccaactgattcccatccagaaatacaggggtttttggggcaagccaaaagccttaatcaacccctacagtcaggtgaaaacatttgcctaagtaacagacggtagaaccagagcttgaaagcatggagtcctggtcaggttctgtccagcacgctactcagtggactttctcggggagcacagtcactggttttgcataaaaccttccaggctccataatggaagggagaaccttagctgaatcgagttcttgggcaggctggatagacccgcagactcagaaagcaagcactgggttttcacaatagaaatatgtttttgaacattctaataatcaccacaaaagttattctccatgagtttactgaaaaaaatcaattataagaaattgaccatgtatagttttaagtgtttttcaatgtctaactcctagtcaaggattataccataaggatgggtttaatcataaaagccaaccatattccagtgaaagtcatcaaagaaaacataaaatctgtctggagcagattcagggacaaacattaatcagtaactcaaaacagtgattaaggtgcatttttctgaagctttattttttctgaacaagctgtttatcttgatttatgttaaaatgtgtagcaaacctggtcgtatcaaaataaaataagcctaatcatggga

SEQ ID NO: 46490 - DNA, 393 bp, Homo sapiens
gggacaactgtacaaccaaatgtacagtcagatccactgccctgagaatgggtcttttccacggagcgtcgctaggcaggtcagatagcaacagttttctggggatggggctttttggggagcttcaatcctgatctgctccctctagtggctactagactgctggttttcacagctactgtggttccaaggacattggtttcaactcttccacagatctggggagaggggagtgggtatggggcaagttgaatgtcacaaaacattcggttcttgctgagattcctttgtttttcttgcataaacactctttgaattgttgcaggccttttttgcaacatgcttgttcagtgtggttttgatcccaggaacttgctggaaaagcagaggtgc

SEQ ID NO: 46491 - DNA, 413 bp, Homo sapiens
cacaaagctgggcgtcatctttcattcctcccctcttccacagccagtcatttctatctggcaatggtttgtccttaaattcttttccagtcttcttttctacatctccattgcaataactaattgcccttttcttgcttaacttgtgtactgtcttattctaggtcctctggaacagtgctgtccaatagaaatattatgttattttaaattttctagtagctacgttaaaaaagataaaaagaagcaagtgagacggtgcagtggctcacacctgtaatcccagcactttgggaggccaaggcagacaaatcacttgaagccaggagttcaagaccagcctggccaacatggccaaaccccgtctctactaaaaatacaaaaattagccaggtggggtggtgcacacctgt

SEQ ID NO: 46492 - DNA, 222 bp, Homo sapiens
tttttcatttccatgatggtaaccaaagaaagaaaatgtctaagtgctggcttgacagcatggagattttttaagggtcctctttggtttctgacttctgaattttaagtatctatgggagcattaataatgaatccatctttgctgctgacatcaatggcaatgcctgatcctaaggcacagaacttaccttggccttagaaccccaaagaaaaattccat

SEQ ID NO: 46493 - DNA, 764 bp, Homo sapiens
caattgaatgtgggacatttttctggcatgtcttgctgctgagaatcggacttccagtcaaaaccctgttagtgacacccacctcctccagttatgcaaattgatgcttagcttggcaagctttcaaggaggtttgcttggaacaggaaaggaattaacaaccctttgagggtgtcatttttaccttgtaatacactgtggaaaattctggaagacggtccttgcctgaaaaggtgcaacttagcattaggttgttatcagaaaccttgtcaagtctgatgggaaatgaatagatgctgctttatttccttgataacttctttggaagtctgaaataaatcctgccttcagtaactgaaaccatttattaaaaatagcaagaaacaagatggggaccaattctatttttattcttgggaatttgaaagagccacaagtgattggtgtccgatctcccagcatatactgtacactattttgtatttctcctgaaccaaaaccaagtacttagcactcaagaaacagatgccctgtgtgtgaccgaggggagtgtttttccacaacaggttccacttctgaacacttggaaggaccttgcctgattcatggtgaaacacagaggttttggttggagataaatttggggtcagttactgttcaaaattgtgaaagtagttcccaggaagacagcattagtgactccgcagtgctttgggtaatagattttgaaaagcaattgtgagttggggattccatcatttcat

SEQ ID NO: 46494 - DNA, 784 bp, Homo sapiens
aagtttttctccaagaccacaaaaaagagttatttaaatgaagattcgtaccacactttggaatgagaagaatcaacattgtgaagttattctcttcaaatttatctattaatctaatataatttctagacatgattcaaagaaatgatgggacagaaattttggatacccaggctctgtgaaaggatcagtttgcttctctttcttccctacacaaaatcaacatgatgggatattcaggaatatttcatactggtttcaatttttggggatgaatttcttcatatacctgcatagggaatgggactcaagccgctcacccctaccccaaagcttcctgtagggtccagacagagagttttgcctgcagttattctataatggctcttagcagaaatggttggcagtgatgatatccagttaccactcatttgaagtaggtttaatgaatgggtttctctgtttttgtttgttttattttattatttatttgttaaatttgtttcatttattgtagtagtagctagctggtataatttttagataaaaatttatcaaaagaactttgtaagtgtcgcatgtcacatttgttgcaataatgtgaaatttatctttctgagaagcttgtgcttgtgcagagatcttgaagtggcttacttcattacaattaagtcatcatttgcttttttcattttttttgcctaaggggaagagggaataattaaatgtaagatacacctcatgagggtttcagggaatttgaccagtggacttcaagaacaca

SEQ ID NO: 46495 - DNA, 490 bp, Homo sapiens
ctggtgcaaagaacaacactggatatagggcaaggggttgggttctgttgggtggcccttttcctggacagaacaactactggatgcgaaatagactctatgccaagttgaactttcggcatcaataaatatggcaccgtctgaggctgtgagttctcatcagtacctgggtcatacggccgacacgccggctaaccaggaggcatctctatttacagaaaacatgatctatgttgcattttacatgggttctaatttcctctccaaacacacattacacacaggcgcgcgcaccacttctcaggatgatagctacaactgcagagatcgtaaattcactaagtctctcagtgcaggagggtgggggaccgggagaaggtgggctagggaccatcaaaatgagccacagttggagtaagggtcctaccccttctgtgctccctccctttattaagacagcaccttccccagagctgacaaaccaggggcc

SEQ ID NO: 46496 - DNA, 793 bp, Homo sapiens
cagggaaaagataaaatatttgtcagcatcttctgttgaagagtctgtgagtctgaggcttgggcaggcagaaacagattttaaacacttccgggggctatgaacagaggtccctcaaggaggggaagactgcccccacccctcacctgacaggtacagaagccttggtcaggactaccctgtcccccacccaaggcccagagcaaggagtggcccacccagcttcggtagccactacacaccctttgtgaagtccctcagactctgcccagtgcttcacgccacgctggtttggttgaacagtcagagcggggcattgggttgctgtgtgcagcctgggcgggttcctgggtcatggggagggacggctgcctggccagggccctgtcacagggccatcactgttgctcgcagcaactgggagagattagtgcagctgtcggatgtcagttctctgccccgagatgggcaggggagggtgggctgaggagagaagaatgtgtgagttggttgggactctagaggagaggttgtttgcacttactccttctggcctctggagacagaacaggaaaaatgaagcatgaaatcccttttgagaaggaatgccagtctctccattaaaacacaataatgaggaaggaattcagtatctgaaggaaatggtcaagctgagtggcagcttctcggcaggtatttcgcaggttcttctgatgagggttgcagggagcagggagtgtcagcattaggaaatgctcccagctgagccagcgtccaggcattaaggatgtgt

SEQ ID NO: 46497 - DNA, 318 bp, Homo sapiens
tctttaaaatccctttagatgactttatttttgttaaaatttctgcagggtcttcgaagaaaaacataaatatttctgagaaatctggatatttttaggaagtgattgtgcattttgagaaaaataccaattagattacattgtgaccttcaatcaggaaatcttggttctgatgatttgatatttagtctcgatgttttgaattttatatattattcccaagaaagaatgtaacaccaggaaaatttcactgaaggagcaaacaccaagtgaatacagaatgtggcagaagtgcttatgagcaaaatacttagttaa

SEQ ID NO: 46498 - DNA, 712 bp, Homo sapiens
cgtctgatattagggaagattgaattgcgttaatctcttagccatgtgtggggaggccagatggacctgctactttgtagccacagccacacttgacctctttgaggttccttttctccaccagcctggctgcagcgtggtgaggaaaagcatgtggtttgaagttgcagccctgagttcaagtcctagtttcttcccttacaatgtaaccctggccctgctccccttactgcagattctgccaagagccttaccctctctaagcttcattcagtcctgtatcgtgggcatggtaatagtactgaatgcagagttgctgaggattaaatgcacgttaagtacatagtacagttccccagcacacagtgatcatatatgtgatagccctttttgcagttatttttatcaaatggcaatcagagaagccttcccaggacaactttatctaaaatagcactccctcctctgctttatttttatacaaaattttatatagcattcccttagtctgctttatccttcctcatagtatttatcaccagctgacatatatattcctgtcagccccactaaaatgtcagttcagtggccgggtgtggtagctcacgaccgtaatcccagcactttgggaggccgaggcagatggatcacctgagaggtcagaagttcgagaccagcctggccaacatggtaaaaccccatctctactaaa

SEQ ID NO: 46499 - DNA, 144 bp, Homo sapiens
aaggatggttggggccacattctttcaacaaatgctgaacacctatcaagtgcccagcacagaacacttacaggtaaacaaaatatacaaaagctcctgttgtcatggagcttacatcctaggtggaggatggagaaataaaca

SEQ ID NO: 46500 - DNA, 622 bp, Homo sapiens
taatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagc

SEQ ID NO: 46501 - DNA, 639 bp, Homo sapiens
atatatacatgcttattataaaagccttcagacaatacaggaatctatagaggaaaaaaagtatcattctaccactcagaggtaacaactgttagtgttttgatataaagcttcctaaattctttttatggctttacaaacattcagataactataggccatctaaaaaaataggatcagattatgtacactattttataatgtgcctttttacagaatttctgtatgaacaggtatacattttcattataatttttaattgcttcttagtattccattgtatgtgtgccatttacggttatttcccatttttcatgaatagaaaggatgttcttgtatatttttttacctctgttttcctgtttctttgctatgaatacttcaaatggaattgtagtgtaaaagactgtgtacttttacaaattttgataataattgcaaaattgctcttcaaaacagttgtatcaatttccttgcccactaatgtgggtgagtgcccatgtctccgcaccattagaagtcatacagattaaagactgtgcacggtggctcacacctgtaatcccaggactttgagaggcagcagcaggaggatcacttgaggccgggagttcaagacaagcctgggcaacatagcaa

SEQ ID NO: 46502 - DNA, 263 bp, Homo sapiens
tcactctgcttcctgtccttattctaccccccaaaattgattaatttctggtatatcctgccaatatttcttcatgtaaatgccaactgaatgtaagcatacacttctcagacaatagctaaaagaattcctctggagcctatataatttagcattcatggtcaataataacgtgtcttgaagctatatctatattttcatctgtctatctcttatctacctgaagcacttcggaaatagatgatctgctcaaacttgataag

SEQ ID NO: 46503 - DNA, 309 bp, Homo sapiens
tctttcactagttccaaaaagggctaagctttgttgagcggcgtccagtaatgcttccagtttttcagtgagccagtctgcaattgtggacagcagttctgatcaaggctgctgtggagcccttgggaatgcttaggtgccattatgatgctctgctgggatggtgggaaaggtaaaagaatgtgctctgcatattctttatttcattatttgttttggggtataaatgtcagatcaacttgttgaagtcatgaggcattctctaagctcgtagggcttgaatttaaaatacatataagttagcggtct

SEQ ID NO: 46504 - DNA, 538 bp, Homo sapiens
agtgtaactacctatgctggtttacagtctttttttaaatgaatttaaaagtaatgtgtgttcattaaagaaaattttgaaactaatgaatagcagaaagagaaaagtaactagaataagtttaatagttagggaccttatttttagcttttatttagaattactaaagtacatatattaactacttttagttaaaactaaaaaatttgttttataatatggaatttgatatgtatatcttagtcatgcttttttttaggtaaaaattttgcacactgatttgaagtttaggaagaatttcttgatttgtagctttgagacacgaaggacatcctatttcatatcaaataggatatcaaagggctttttgggggtttatgggatatcagggagaacataatgcatgatttagtttgtagttttaaaatctaggatattattgaaattcaattgatgaatttttgaattcatcatttgagttttgaatgttagatattggattatcatacaaatttttgttaagttttctgttaaatac

SEQ ID NO: 46505 - DNA, 394 bp, Homo sapiens
ataactgtgcaggagttattctcagtgctgtttctgcccacagaggcatctccccttgtttctctgtaagagtatagcagtggacattcactgatggcccattgatcctcagagtacatctctcttatctatgagattcagagaggggaagcaaaaagcctggagtcacacagcaagccaggagtctgtgggtgtctagtcccagatctggagccctcgctcagctgcacttctgcaagatgcctcttctcccaggcctttcagctgccaccttccgctcagttagtccaatcctgactgacaagacacagccagtttctgaggaaggctgctgcgtttacactgcgagctgcggcccaagaccccagatctcactccaggctcctgggatgtt

SEQ ID NO: 46506 - DNA, 441 bp, Homo sapiens
cttccactaaatattgaacctctcaagcttagttctaggcccagctctcttctcctcctctctcaagatttcagttactgtctaaatgcctctgtctcccacaggtgtacctagcccactcttctgctttgtgctgtagacttatagcccacattaaatctccacttggatatagacagtacaccaaatttagcatgtttagctggatggatgttaccaccatccatccaattccatgacacttctactccctccattctctatgtctggtctagcactaagttacactgattttattcattaactctcttttaaatccacacactcctcttgtttttcacatacaccaccctagtctacgcatgatctctgggttgcatgactgcaatagacttctcactggcttcttccccactggctcctctccagcatcctcttttt

SEQ ID NO: 46507 - DNA, 401 bp, Homo sapiens
ctggagttgttgatgtattacctcctaatgacactcttgagtgaaagcacctttgagggtcatctagtcaaaacaaaccaacgaataaaaagcaaacctgaaagtgaatcttcccaggtctttagatgtaagagatgcaagggaccgaggaatatgacaaattacaccatagggataaaatgaggaaaatctgggctatgcaaaactccatagggcaaatgatctaagttttcaaccaaaaaagttgcaattagggccaaatgtatccaaaagaggcttaagagacataggttcctatctccacacagggaccttacttggatctcaactgacatgtgtctgttaatgaattaattggtcaaatggaactaaatgaaaataaaaattaaagtaaattaata

SEQ ID NO: 46508 - DNA, 484 bp, Homo sapiens
tctcttcctggattttgcttaacatttaaatatcaaagatagctgtctttgatagtcctcccaaactgggcagcaccatcactctggccttcgaagggagctataaagctcactagtagtcaactcttaaaaatggggcattattcctaaaaaggaaatatacagctttaagcaaataaacaataggtactttgaagaccattttaaagaacttacccatagcccaagataaacatctgctaaggatcaaaaagatcaggccctgggcaggggcttggggacagtgtggacagggacacacatagctaactgcttttcaaaaattggaaaattaaagccctcctaccaaggattacaagaaaaccctcaaagtttagcaggtcaagtacaaactaataatcaggcctgccaagaaagaatttgaacaaccttgcaaagtattccaaagaaaataaaaaatgttgcttaacaagatacaaccctt

SEQ ID NO: 46509 - DNA, 434 bp, Homo sapiens
agataacaggcaaggaaaacccatagagggtgaagccaggagccatggagaacaacaaaggactagggagtttctcctggagaacaaaattagggccttaacaaggaatttcttccttcacaatgttcatacatccagtgggatttcataatgctacagattagcaaccactgaatattttccatttttttttttgcatttctaaatgcggtgatcctttctctgtttccccatggtatgtgttttgtacagagggagacaggacagatatcttctctttaaggcgtatgttgtggggacatggagagcgacatctacatctgatgaagaagattatgtatgaactggagatcctagattttgtcctggctgggacctttggtaatcttcctagtggagagcttgagtgcattctatatctgggaggaagaatt

SEQ ID NO: 46510 - DNA, 1964 bp, Homo sapiens
tttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttttgttttttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacctctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttata

SEQ ID NO: 46511 - DNA, 434 bp, Homo sapiens
ggacgcgtgggtcgacccacgcgtccgaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctat

SEQ ID NO: 46512 - DNA, 2280 bp, Homo sapiens
tttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttttgttttttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacctctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctat

SEQ ID NO: 46513 - DNA, 1938 bp, Homo sapiens
acagccgctcattcctgtcgtaaataccagtgtcttcattgatggtgggctgtgttgtttccagtgtttttgtgtattggatctcatttgatccttataacctgtgaggtaggcaggtcatttagggataagcatcgtctttattttgtaaatgagaaaactgaagcccaggtgtgattttccccaaagtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacctctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctat

SEQ ID NO: 46514 - DNA, 1785 bp, Homo sapiens
tgttgcatgttacttttaaaaatctaaggccaggcgtgctgggattacaggcgggagccaccgtgcctggccaatgttaagtattttaaaagtcattttaaaatatttgtcattgatgaaacttggtttcagcacacgtaattgctttccctctcttcttgtgattaggtgtaaacctctatttaactcaagtcctagattagaatgtcctttgtcctgatgtttgcagtaattgcttccttggttaataaagatatttttgaaatatactctggactgttggtgaaagaggcaggcatggctttactggtactagtttggcactgaactgtttgggtgcccatgaggtaggcagaccttatgctttttttttttgagacggagtcttgctctgttgcccaggctggagtgcagtgatgtgatctcggctcactgcaacctctgcctcccaggttcaagtgattctcctgcctcagcttccccaatagctgggactacaggtgtgcgccaccactcccagctaatttttgtatttttagtagagacagggttttgccatgttggtcaggctggtctcggaactcctgacctcaggtgatccacccgcctctgcctcacaaagtgctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctat

SEQ ID NO: 46515 - DNA, 1559 bp, Homo sapiens
tttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttttgttttttttttttttttttgagtcagagtctcactgtccctcaggctggagtgcaatggcgcaatcttgcctcactgcaacctccacctcccaggttcaagcgattctcctgcctcagcctcccaagtagctgggattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctat

SEQ ID NO: 46516 - DNA, 1215 bp, Homo sapiens
gaatattgggaccccataccgttagccctgtatgtataccaacactgccaaagtaaaacattacaggcatgagctaccgtgcctggcctaaaccttacgcttttgaggttgagtgcaggccttgtgataactaagcgctacttttgacgagccttcaacaagctgcccagtcctctcctcagcagacgcatcaggttgtagttgcatctttacagtggtctttccttttattaaatctatagcagtgaatatagatttgattcaacttttagttacgttctctcaagaatcctaatcaactttcagttagcctcttaagaaagggaaaaaaaggtgctgccagtcatccccaaattatgtttttggctgtgcattctattttctacatagcactgaatctgagtaacagtcatcctggatttatagttggaacagaacagtaacagacctaactgggactcagccagcactagcctcatcttagctgccccttttctctgctttgcagtttactgcttccctgggctagccataacggggttctgggcaggtcagactcttcagcaagacagtgtattaatagtgtgaattagatacactgatgacctgctctgcctagttaagaaactgaattaatcagcagttacaaagcacatactttgttacgtgctaggctttgcctcctggcctctagataattaagacggcccagggaataccagcagagaagtgctaattgtatttgggtgttacaaaagcagacctagacgagctgttcacttaactggtacctgttggtcagaaaaagaatttatttagagattatgatcatgtaaaattacagtactcaacccttctagcaaagtatttttttgaaaaataaactaaatgcctttataaacttgtgttctctcgtcttgagtaacatgtactgtttggcgaggagtaatttttttcttgtgacattccagtcacgacagaggtcatttcagaacagtgagcagtgcaggccctaaccagctcaccctcagagcagcagcaccatcactcgaattttctacaacggaaatgttctatatcttcatcttagcttgactgagaaactgaatgtttaattctcacacttcactaacatgtattaatagtgatgccttcatctgtacgtttgaattttcacttttctccgattaaagtgagaaacaggtcagatgctat

SEQ ID NO: 46517 - DNA, 766 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaaccgtgactagtgggatcctcaagtcaccgcagcatcagtc

SEQ ID NO: 46518 - DNA, 156 bp, Homo sapiens
cagctgcagactgccttgtaccaccctggggctggtcttaggagggtgctaggctgcagactgccttgtactccctggacaccctcaaatggggttttctgtgttatttcataaaattctttgaagtccaataaagcatgtaggagattttaacca

SEQ ID NO: 46519 - DNA, 4021 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaacca

SEQ ID NO: 46520 - DNA, 2979 bp, Homo sapiens
ggtgttgaggatcgttttaaccctaatcgcccggaagctgcagctcagtggcatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaacca

SEQ ID NO: 46521 - DNA, 2148 bp, Homo sapiens
cctctcttatcctatacttatggctgctcaacttctgtctattcctctttcctctctccttcccacctgcctgttcatcctatttctctctcctgccgctctatccccattttcctaccctgtccttgtcttctcgtgttgtccctctctcctcttcgcctttcccctatcacctcatccaatatatgtccctttcttcctctctgccccatgtcttgcagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaacca

SEQ ID NO: 46522 - DNA, 2886 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgacccagcccccggcttcggggtctactagagtcgg

SEQ ID NO: 46523 - DNA, 2240 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtgtaggtgacctctttggggggatgaaggaaggagcctttgatgtacaggttgagaagtctgtggcctctgttgtgcttaaacagcagatggggcagatacccaggaagatagttcaactcatgaccttggtcaataaagcacaatttactcaggtt

SEQ ID NO: 46524 - DNA, 317 bp, Homo sapiens
gatgcagtggagtctgcaaggctaagtgtgcagtgggcaccctaactcatcatgccctcccctctctggcagtgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggtaaggcctgccccttcaggaaaggtgaggccctgccagttcttgggaacctcctatttccacctgg

SEQ ID NO: 46525 - DNA, 4106 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccaaaaaaaaaagagtgtgtaattatggtta

SEQ ID NO: 46526 - DNA, 4078 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaacca

SEQ ID NO: 46527 - DNA, 4026 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgcctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaacca

SEQ ID NO: 46528 - DNA, 4075 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcaggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctccaccccgctttgccatcccagtcccttccaacatcggccagttcctgttgtttctggtctttgtaggtagggcttcccagcctgggaagactttttt

SEQ ID NO: 46529 - DNA, 2715 bp, Homo sapiens
  misc_feature (8)..(8): n is a, c, g, or t
tgggagcngctgtcctgggcctggccggtgtgcgtccgcctgctggacctgggcaccgccagccgcctgggcacgggactgggcgggggcgctgacctcggcctaggaggcccaggatcccggagacgcccgcgccctcaggaccctgcgggtcgcacgccctccccagcttctgctgctcgctgctcttcggcagggcgaggtcaggtgcccccttctcgcctctcttctcttctcttctcttcctcctccacttctgtgcccgcggagactccggccgcccccttccgcaggggtgtagtaatctgcggagctgacagcagccccgcagccaccctgcccgaagtctccggaagcggcacgagctcaggccgccgcagccccggcggacccactgttggacctgaggagccagccctcctcccgcacccaaacttggagcacttgacctttggctgttggagggggcaggctcgcgggtggctggacagctgcggagccgcgagggcatcttgcctggagaccgtcggctgcactcccgggctcctggctttgcctctgggatcccgaggtgtccacatcagacgcatgttgactgagacctagagtcatggatgtatgcgtccgtcttgccctgtggctcctctggggactcctcctgcaccagggccagagcctcagccatagtcacagtgagaaggcgacaggaaccagctcgggggccaactctgaggagtccactgcagcagagttttgccgaattgacaagcccctgtgtcacagtgaggatgagaaactcagcttcgaggcagtccgtaacatccacaaactgatggacgatgatgccaatggtgatgtggatgtggaagaaagtgatgagttcctgagggaagacctcaattaccatgacccaacagtgaaacacagcaccttccatggtgaggataagctcatcagcgtggaggacctgtggaaggcatggaagtcatcagaagtatacaattggaccgtggatgaggtggtacagtggctgatcacatatgtggagctgcctcagtatgaggagaccttccggaagctgcagctcagtggccatgccatgccaaggctggctgtcaccaacaccaccatgacagggactgtgctgaagatgacagaccggagtcatcggcagaagctgcagctgaaggctctggatacagtgctctttgggcctcctctcttgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggctgagaagataaaaaagaagagaaacacactctttggcaccttccacgtggcccacagctcttccctggatgatgtagatcataaaattctaacagctaagcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtcccctagcctgcagagcagtgttcggcagcgcctgacggagccacagcatggcctgggatctcagagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtagcagataagtgcagaatgctgtgggtgcagaataagatccggtagacg

SEQ ID NO: 46530 - DNA, 321 bp, Homo sapiens
ttttatctacctccagcccctatgccgtgagttactcaacagtagggacttaaaacagtgcccgtagatagcaggtggtaaaaatgttttttgaatgaaactcaccaccctccaaatcagaatgtttttctttcctttcaggcaagctgaaaaattataaccacagcttcagatactgctcatcattttaactagatgtttcccccttttgtatccacctatccggttctccttagagaaggcagattctctagacattattcactataattggtctctgggcttttattcagggattttcctgtcccttgctggtgtctt

SEQ ID NO: 46531 - DNA, 229 bp, Homo sapiens
gagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcatggaggaaagttctagctacccccggactctgaggaccgtgcggccaggac

SEQ ID NO: 46532 - DNA, 550 bp, Homo sapiens
gagctgcccactcatggttacaaactaaggcatcaaacacaagggaggccccgcccccccaggaccacacctccaggacctggtcgacccagtatgccagcacctgggactcgtcaggagaatgggatggccacccgcctggatgaagggctggaggacttcttcagccgaagggtcatggaggaaagttctaggtgtgatgcctaaacacactcccattttcagcaggccccaaggccctagaagggctgctgtgtcctcccagctcccatgggagtctccataacagcagtgcccaaagccagtctctgtgagaaatttccccacattctcatccttccccacccagccctcagggcccatgacctctgcgtcttcccaggacagctgggaagaatggggccagagtgaaccaccacagtggggttggagagcaggtgtggatgagagggaggtggggggcagccctgggacaggatacccattagtggtgagaggcccggggggtagtgttccctgtcactgtcctgcagactgcccagggtctgtc

SEQ ID NO: 46533 - DNA, 364 bp, Homo sapiens
cacgggtggcagagatggaagaaaatccatctataagtggacccataaacttcaaacctgtgatgctcaagggtcaactctgtaataaaaaatgtgcgtgtatgcgcatgttctcactcataggtgggaactgaacaatgagaacacatggacacagggtggggaacatcacacaccggggcctgcccgggggtcagggaagcggggagggatagcattaggagatatacctaacgcaaatggcaagttaacgggtgcagcacaccaacatgtatacatatgtaacaagcctgcacgttgtgcacatgtactctataacttaaagtaaaataataataaaaaataaataaataaataaataaat

SEQ ID NO: 46534 - DNA, 249 bp, Homo sapiens
gggagatgtagactgcagagaacgaacaataatggaaagttaggttaaaaaattagagaaagaagagtggaaataaaggattcggggaatgggaaaggtagggacctcggcctcatcatatcccattgttatttactttttattttttattaaagacaaggtcttgctgtgtcgcccaggctggggtgcagtgttgcaatcatagtgactgcagccttcaactcctggacccaggtgatcttcctacct

SEQ ID NO: 46535 - DNA, 1025 bp, Homo sapiens
ctggagggcttttaaaaatttgaaaaaaggtaggctttgtgacctcacaaagcaggaaatctgtttaacctctacatccaaattaggaactgtctaaggctgaccccttttacagtggtgactcaagacccagctagattttgggaattctaatgtgaattcatagagttctaatgctagattaggaactctaatgtgttctgatgttaagaaggagtgtattctgtgttattcacaggaatggtgtagagattagtaaagatgtggatagccaaagagaagttgagcaacccgtagtattttactcactgcagcaaaatgttttgataaccattttagagttgctctgataggtttcaagctgggagataattagattttattttaaaatatttctattttttgtagagacagggtctcgctatgttgtctaggctggtcttgaactcctgggctcaagcgatcctcctgccttgacacccccaaagtgttgacattacaggcatgagccactgcacctaacctggaataattttttgaaggcatattcggtactgttgtactagggtaaatcacaaacttgcccccttataccatactcggatgaaaagtgaaatctagttaaagtgaacaccagaggtacactcaaaacagaatgggagaaaaagcaaaagattcctggaagttatctagaaaaagaatgggaatctttattttttaaataagtgcaagttttattgatgctctctattgtatgagagctattttttcttctttgctgctgtcagtgtacggaagctgttcactataggttcagtttgatttattccttgttaattctacaaatttattatttttatgggacatgttgtgtttggggatataaaaaatagtttattatgtttaagggcttcgcagcttagtgagggagacacatgaatgaaataatgtccatatatgatgagaggtaaacacatatcctatagaagcatgccaaaataagctgggggcgttggtacctgcct

SEQ ID NO: 46536 - DNA, 638 bp, Homo sapiens
gttatgcaccattatagcaaaaaaattgcacactgataaaagtaactgttccctcgttggcttcaccagctttcccaagaattgtttaatcccattccctgtataaaatcactctctgctgagaatcctttttctgagaaaagaattctgagaattttttttctgcttgaggcagaccaacactcattccaagaacaactggaaaggctgaataaaacacagaaaacttttttaaaaagtttttggaaagcttcccagttaacaaacatttgaagggtcataatctcaaaagaagaaaaacacaaggaggcaagctggccctctgtgaactacttttcccttcaggaaacgtgctgattttagctaagaggccgagcatttgggcagacggccatagctaagaggcagcaaaggcagcagagtcttcagctggagagacaagaaatggagactgaggttgtcaaggcagctggaactgaaggggccaagatatcatgtagaagggagacacagaaaaggaacactttccccttgaggcatctgctgagttaagctatgcagaaaggctatgaaaagcagcaggttttggcagtgtcatattaatgagataaaagttggagttcaggacccaccaagga

SEQ ID NO: 46537 - DNA, 400 bp, Homo sapiens
gtttattgatttgcatatattgaaccagccttgcatcccagggatgaagcccacttgataatggtggatcagctttttgatgtgctgctggactcagtttgccagtattttattgaggatttttgcatcaatgttcatcaaggatattggtctaaaattctctttttttgttgtgtctctgccaggcattggtatcaggatgatgctggcctgataaaatgagttagggaggattccctctttttctattgtttggaatagtttcagatggattcacagccgaattctaccagagcagaaccaggagtagtgacagataagacctagaagttacaggagctatggctgtgctaactctgcagagagaagtgcagtgtcatcagactccatgctggagttt

SEQ ID NO: 46538 - DNA, 484 bp, Homo sapiens
gagtatgaagcatgagtgataatgttggggaattgagagaatgatgctctgaaataagtgactttcattggctatgattgccaggctgtgacaattttcaaggatagacaacctcaaatttacttattactgtcataatgcagtaaaacacgccaaaaaataaaatatgatcaaatgcagttaccgtttattttggactgcatgacaatattcacttgcacaaaaccatataaacaacacccacctgtgtttgaaggcaaggtatctttgatcagaatctctgaaatatccctttgagttagctatcactatagcaaactttattaatttgtacctgacagtaatttaggatttatgattatttagttgaactaaagcataaatatatgaaggaagagttagccaagtaagtgaatagtgtgagtaacaatttctttggcaaggagtgaggggaggggatgatctacagaaaaagaacagagtt

SEQ ID NO: 46539 - DNA, 1442 bp, Homo sapiens
gcttactcacgttgcggccttcctcgcgtcacagccgggatgaagccgatcctactgcagggccatgagcggtccattacgcagattaagtataaccgcgaaggagacctcctctttactgtggccaaggaccctatcgtcaatgtatggtactctgtgaatggtgagaggctgggcacctacatgggccataccggagctgtgtggtgtgtggacgctgactgggacaccaagcatgtcctcactggctcagctgacaacagctgtcgtctctgggactgtgaaacaggaaagcagctggcccttctcaagaccaattcggctgtccggacctgcggttttgactttgggggcaacatcatcatgttctccacggacaagcagatgggctaccagtgctttgtgagcttttttgacctgcgggatccgagccagattgacaacaatgagccctacatgaagatcccttgcaatgactctaaaatcaccagtgctgtttggggacccctgggggagtgcatcatcgctggccatgagagtggagagctcaaccagtatagtgccaagtctggagaggtgttggtgaatgttaaggagcactcccggcagatcaacgacatccagttatccagggacatgaccatgtttgtgaccgcgtccaaggacaacacagccaagctttttgactccacaactcttgaacatcagaagactttccggacagaacgtcctgtcaactcagctgccctctcccccaactatgaccatgtggtcctgggcggtggtcaggaagccatggatgtaaccacaacctccaccaggattggcaagtttgaggccaggttcttccatttggcctttgaagaagagtttggaagagtcaagggtcactttggacctatcaacagtgttgccttccatcctgatggcaagagctacagcagcggcggcgaagatggttacgtccgtatccattacttcgacccacagtacttcgaatttgagtttgaggcttaagaagctggatctcctgccgggcgtggtggctcatgcctgtaatcccaccactttttttttaaggcaggcggatcacctgaggtcaggagtttaagaccagcctgaccaacatggagaaacctcgtctctactaaaaatacaaaaattagccaggcatggtggcacacgcctatagtcccagctactcaggaggctgaggcaggagaatcacttgaacccaggaggcagaggttgcagtgagctgagatcacgtcattgcactccatcctgagccacaagagcaaaactccgtctcaaaaaaaaaaaggaagaaggtggatctccaaccaggccagagaagattctcacagaaggttttgaactctaagaaataacttggttcggaataaatggcttctggtcagataaaacaaacaacaaacaag

SEQ ID NO: 46540 - DNA, 908 bp, Homo sapiens
ctgtgcggtccaatcctagccaataggggaatgacacaacagcagggactacctgcaccaggaatacgaaccgcttccctccccttgttcaggtgtgctttcgccattactccaaccacgagtcgcacccttctatagaagtaaaaattacaggcatgatccatagggctgcaatgggagcctaggaaccatgaacaccccgcccccggcttccggccaaaacgttcctacagcggatcaaaaatttcccacccaagacccctggtgggacaataacaatgcagccaaccaagaaaatatgcaagaccttaaggaattgataataaaggggattaaagaatcagtaccccgaacccagaatcttacccaaacatttgatatacagcaagggaaagattaagggcctatagaatttttagacagattaaaggaataaatgagaaaatatactggtccaggtctcgaggatccccttggacagggaatgttaaaacttcattttgtcactaacagttggccagatattaacaagaaattacaaaagatagggaactagaaagataaacctatagaagagcttctaagagaagcccaaaaagtatatgtaggaagagatgaagaaaaacaaaagcagagggcaaaaattctgctgtccaccatacaacaaagtacccagggggcaagaacctataaagaacctagacccccactctccaggcaacataaagggtacaaaagagtaaagccaggagactcaaaggtagagaaaaaaatcttagaggcgagagaaagactgacagaggggacagaggaagtcagagagagagagagggaaagagacagaggaagtcagagagagagggaaagagacagaggaattcagagagagagagagagagatagggaga

SEQ ID NO: 46541 - DNA, 923 bp, Homo sapiens
ctatccctgttgtccctctccttataattctgcctcttgggaatgttcccaagagcccactcacgaccagcctgagtacccttccctaaaaggacttcacacgagatagagcaatgtaaaaaggatattcagaacttccctttcccctcttctcaggggaagaaagaggcatgatccatagggctgcaatgggagcctaggaaccatgaacaccccgcccccggcttccggccaaaacgttcctacagcggatcaaaaatttcccacccaagacccctggtgggacaataacaatgcagccaaccaagaaaatatgcaagaccttaaggaattgataataaaggggattaaagaatcagtaccccgaacccagaatcttacccaaacatttgatatacagcaagggaaagattaagggcctatagaatttttagacagattaaaggaataaatgagaaaatatactggtccaggtctcgaggatccccttggacagggaatgttaaaacttcattttgtcactaacagttggccagatattaacaagaaattacaaaagatagggaactagaaagataaacctatagaagagcttctaagagaagcccaaaaagtatatgtaggaagagatgaagaaaaacaaaagcagagggcaaaaattctgctgtccaccatacaacaaagtacccagggggcaagaacctataaagaacctagacccccactctccaggcaacataaagggtacaaaagagtaaagccaggagactcaaaggtagagaaaaaaatcttagaggcgagagaaagactgacagaggggacagaggaagtcagagagagagagagggaaagagacagaggaagtcagagagagagggaaagagacagaggaattcagagagagagagagagagatagggaga

SEQ ID NO: 46542 - DNA, 489 bp, Homo sapiens
gaaaacagaccactgggtgtatcacagcaatggtgtggtggccaggacatgggttgcacagggccaaggagcaaggcaattagagcagctagagatggatcatgaagtccagactggacggtgagggcctaggaagctggaggtagtacagcagttacagtcacaccactggaggttccagtgaggcttctgaagattagtgggcagaaaggaaagtttgtggtcaagaagggaacttttgtttaattgatacataataagtatacatatttatgggtaatatgtgatattttgatacatgcatacaatgtgtaatcaaggtaattaggatatccatcacctcaaacatttatcatttcttcgtgttgggaacatttcaaatccttttctagctgttttgaaatatacaataagtggccaggcagagtggctcactcctgtaatcccagcaccttgggagatcgaggtgggcgatcacgaggtcagggg

SEQ ID NO: 46543 - DNA, 517 bp, Homo sapiens
aaaaaataaaaaattagctgggcatggtggtgcacaactgtagtcctagctactcaggaggctgaggtgggaggatcacttgagcctaggagttcaaggctgcagtgagctatgatcacgccattgcactccagcctgggcaaaagagtgagaacgggtctcaataaataaataaaaagaaatgcaagttctcagtcctaccctagacctactgaatcacaatttgggagggaggggtgtcccaactgtaaacccaagtttgagaaccattgctttgccaagatagggtcttgctatgttgtccaggagttcaagaccagcctgggcaacatgacgagaccctgtctgtacgaaaaaaatacaaaacttagccgggtgtggtggcacatgcctgtggacccagctactagagaggctgaaatgggaggattgcttaagcccgggagtttgaggctgcagtgagccaggatcttcccactgctcttcggcctaggtgacggagcaagactctgtcttt

SEQ ID NO: 46544 - DNA, 461 bp, Homo sapiens
aaagaatagtgaatggtattagctctgatcttgaggttagggcagctagttccatgtttattctgggttttgcaaattcaaaccacactgtcatcaggcatctttaaatagcagtacactccagtggttaagcttggtttctgtgactcagttacctcttttgaaaaatgggggcagggcgcggtggctcacccctgaaatcccagcactttgggaggccaaggcgggtggatcatgaggtaaagagatcgagaccatcctagccaacatggtgaaaccctgtatctaccaaaaatacaaaaattagccagccgtggtggcaggcgcctgtagtcccagctactcgggagtctgaggcaggagaattgcttgaatctgggaggcagagattgcagtgagccgatatagtgccactgtactccagcctggcaacagagcaatactccatctcaaaaaaaaaa

SEQ ID NO: 46545 - DNA, 370 bp, Homo sapiens
tgatgattgtaagaccagcctttgaagtaaaggagtttgagctgcacctttaccccatgtgcctgtagactgacacatggtgtcaccaacattgagcaccccctgccccccactccagacactgtgctctctagtaggtacactcatctctacctgccttgcaatatttgtatactgcaggggcaggtgtctgggttctggccctggctctggactctagtgtcctgatggagaaagtaggtagggagactggactggattagtggtgtttgaacttttttttcttttgtttactggaacctcttttccaaatgaaatcttaaaggcaaccctagtatataaaagagtgaaggaggaactgctgaggatg

SEQ ID NO: 46546 - DNA, 270 bp, Homo sapiens
aggaagatctggaggaaactgatgatgagggaacagtgcagccttgcttacacctagatagcgtcctttgtcctccctccctttttccttccttcctttccttcttttctttccttcctttcttttcttcctcccttcccttccttcctttccttcctttccttcccgccttccttttcttcctttctttctaccttccttccttttttcttttcttccttcctcccttcctttctccctccctccctacctctctaccctttccttgtc

SEQ ID NO: 46547 - DNA, 596 bp, Homo sapiens
gaggacagacaagggggaagaaaaggaaaaaacagagccactcattccaaagttctcaattcggtgcataagaaaatgattcctatttgttgcaggtgaaaatgtttgatgtgccggctcctttacctcatagttacagtaagaagaaatttaaaaattgggatcaaagatgcagccgccttcccatttaagcagcacagacagcccaaagtgacagttttcctgtacagttactcttctgttatctgtaactgatctatgacattttgggaaaaaacagccaaaaaaaattagtactgaggtaggtgtgcctgattccttccccaattctgctcatgactgaaccaacagaacacaaacacaggtgaaacctgcacagctgtgagagcctacaaaagttcacatgcaagatacttaaaggaatttctgctcaatagagtctgtgggaccacactgacaaacgagaatgagggctctctgggagcctggctttggacctcatgaacatggtctactttggaggtatgaggggtaaaggtaagagaagtagggcagactgggaactgttccctgagtccccctagccactgtggctt

SEQ ID NO: 46548 - DNA, 368 bp, Homo sapiens
agcattcttgctatgcaatacaagtatgtcatacaagtatggttgctaccgttgggcaggtgggccagcaaagttgtatgaaatgttcaagcaacattacattgaataatttttacactgaatcattgaaagactttgcaggcaagcttaaccagcgcagatgttcataaattaaatatccaagtctgtactgaattatttacacttatgtaacatggtaattataaaagcaatagcatatatagtttcaaacagtgattaaaaagttagatatctatgatttatgaagccatacttcaatttagcttatgtatataacttctagaaagtatagctttttggagttgcctaacctgctagtgggaaga

SEQ ID NO: 46549 - DNA, 427 bp, Homo sapiens
ggataaatcgttctgaccctgggttaggcaatgcttccttagacatgacacaaaaagcacaagcaacataagaaaatagataaaataggtgatatcagtatgttttaattttgtgtttcagagtagatgaaccaacagaataggaaagaaatatttgcaagtgatatatctgataaaaaacttgaatatagaattttttttttaaaaaaacctcttacaactcagtaatgaaaagacaccccaattagtaaatggacaaagggtcctaatagacattttgcttatgaaaatatacaaatagtcaataagcacatgaaaagatgttcaacatcattagtcatgaggaaaagtcaaatcaaatccacaatgaaatcctgactcacgctgggcacggtggctcacgcttgtaatcccaacactctgggaa

SEQ ID NO: 46550 - DNA, 523 bp, Homo sapiens
  misc_feature (504)..(505): n is a, c, g, or t
  misc_feature (510)..(510): n is a, c, g, or t
tgcctctgccaggatttatggaatggaacttttcccaagtgggttccaagtaataccacatagactggaaacattcagggggcaggggtttggtaatagcatttcacagaattggccagtctttgttttactcaaggatttttagatataacagctcctcttaaacaatattgcttgatagtagaggcacaacactcattcatcacagttacttttagtgctgttctttcactttctctactcacctccaaaaattacaagttcctcattaacacctgtttttgttttgttttgttttttgagatggagtcttgctctgctgcccaggctggagtgcagtggcacgatctcagctcactacaacctccgcctcccaggttcaagtgtttctcctgactcagctactcaggaggctgaggcaggagaatctgttgaacccggagggcagaggttgcagtgagtggagattgcgccactgtactccaacctggcgacagagctagnntctgncccccaaaaaaaa

SEQ ID NO: 46551 - DNA, 374 bp, Homo sapiens
  misc_feature (355)..(356): n is a, c, g, or t
  misc_feature (361)..(361): n is a, c, g, or t
tgcctctgccaggatttatggaatggaacttttcccaagtgggttccaagtaataccacatagactggaaacattcagggggcaggggtttggtaatagcatttcacagaattggccagtctttgttttactcaaggatttttagatataacagctcctcttaaacaatattgcttgatagtagaggcacaacactcattcatcacagttacttttagtgctgttctttcactttctctactcacctccaaaaattacaagttcctcattaacacctgtttttgttttgttttgttttttgagatggagtcttgctctgctgcccactgtactccaacctggcgacagagctagnntctgncccccaaaaaaaa

SEQ ID NO: 46552 - DNA, 572 bp, Homo sapiens
tgcaactgcagcctcccaagttcaagcgattctagcacctcagcctctggggtagctgtgattacaggtgtgcgccaccacacctggctaatttttgtatttttgatagagacggggtttcaccatgttgtccaggctggtctcgaactcctgagctcaggtgatccacctgccttggcctcccaaagtgttgggattacaggtatgagccagcatgcccgttctataagcaggtcttctcaaatgtaacctcctcaagggcagacgtatctgtaaccccctagcaagctgcaccagctctgacacgtacttgatgctcagcgatgcatcacactgatttcctgccactggactgtgataccagactcagggctcccagccatcacatacagctccctcagccacgacaccccaatacagggatttaaaatctgccttcataatttacttgtggccgggcgtggtggctcacacctgtaatcctagcactttgggaggccgaggcaagtggatcacctgaggtcaggagttcaagaccagcctggccaacatggcaaaatcccatctttact

SEQ ID NO: 46553 - DNA, 1672 bp, Homo sapiens
tgcaactgcagcctcccaagttcaagcgattctagcacctcagcctctggggtagctgtgattacaggtgtgcgccaccacacctggctaatttttgtatttttgatagagacggggtttcaccatgttgtccaggctggtctcgaactcctgagctcaggtgatccacctgcctcggcctcccaaagtgccggattacaggcatgagccactactccgggcttacctccttcttaatctgaaatctacttctgttcctttcttctctgtgaattgcccttgttatttctccttcagctgtccttaccctcagatacgttttccgctgtcggccgcctcttcttcgtgtgctctctcccctcgtggcctcctgcctttctgacagctccttcttcctccactggccccttcttccctctctgaggctcaggcctcagtgtctttccggtctccctacacactcccatgaagaccctctccgcattctgacttcggtgccaccctttatgccggagactcccagatctcatttccggatctgcctccttaacttataggtctggatacttcctgtttggtttttcaccttcatgctaaacgcagtttgtctaaatcggaagtcaacttccattctctgccgcccctccctcctgacccatgttggatcattccgctaatcacagggacccaaaagcttcgagtcacttttggctcatctcgtcctgttgaccctcatctgaggcttcagtgcaaggtttcctttttccattgcttcctcttcttggaacccagaaactgccgatgggtctttaattcttggagtctccttctcagcctcatcgctcaactccttcaggaacccaatggctcagccaacccaggtgggcaccaacacttgaatacactccagtctctccctcttctgacccctttactttctgcactgctgctgctgctaccttgcctgagatattcctccctcccagactcttcactccccttcccactgctgaggagctccccttccttgaccggccagctcacattctgtcttcatcataaagcgctctccctcttcaagaagcacattcagctaacagcgctctctgccagtcgttcatagtttgcatccctcccaggccttagcattttctgccttatattattaaggtttttttttaaccatgtctttttatttatttattttagagatggggtctcgctttgttgcccaggctagtctcgaactcctgggctcaaacaatcctcctgtcttggcctcccaaagtgttgggattacaggtatgagccagcatgcccgttctataagcaggtcttctcaaatgtaacctcctcaagggcagacgtatctgtaaccccctagcaagctgcaccagctctgacacgtacttgatgctcagcgatgcatcacactgatttcctgccactggactgtgataccagactcagggctcccagccatcacatacagctccctcagccacgacaccccaatacagggatttaaaatctgccttcataatttacttgtggccgggcgtggtggctcacacctgtaatcctagcactttgggaggccgaggcaagtggatcacctgaggtcaggagttcaagaccagcctggccaacatggcaaaatcccatctttact

SEQ ID NO: 46554 - DNA, 1084 bp, Homo sapiens
tgcaactgcagcctcccaagttcaagcgattctagcacctcagcctctggggtagctgtgattacaggtgtgcgccaccacacctggctaatttttgtatttttgatagagacggggtttcaccatgttgtccaggctggtctcgaactcctgagctcaggtgatccacctgcctcggcctcccaaagtgccggattacaggcatgagccactactccgggcttacctccttcttaatctgaaatctacttctgttcctttcttctctgtgaattgcccttgttatttctccttcagctgtccttaccctcagatacgttttccgctgtcggccgcctcttcttcgtgtgctctctcccctcgtggcctcctgcctttctgacagctccttcttcctccactggccccttcttccctctctgaggctcaggcctcagtgtctttccggtctccctacacactcccatgaagaccctctccgcattctgacttcggtgccaccctttatgccggagactcccagatctcatttccggatctgcctccttaacttataggtctggatacttcctgtttggtttttcaccttcatgctaaacgcagtttgtctaaatcggaagtcaacttccattctctgccgcccctccctcctgacccatgttggatcattccgctaatcacagggacccaaaagcttcgagtcacttttggctcatctcgtcctgttgaccctcatctgaggcttcagtgcaaggtttcctttttccattgcttcctcttcttggaacccagaaactgccgatgggtctttaattcttggagtctccttctcagcctcatcgctcaactccttcaggaacccaatggctcagccaacccaggtgggcaccaacacttgaatacactccagtctctccctcttctgacccctttactttctgcactgctgctgctgctaccttgcctgagatattcctccctcccagactcttcactccccttcccactgctgaggagctccccttccttgaccggccagctcacattctgtcttcgggtcgtttgggatcctctagaacagcat

SEQ ID NO: 46555 - DNA, 1211 bp, Homo sapiens
tgcaactgcagcctcccaagttcaagcgattctagcacctcagcctctggggtagctgtgattacaggtgtgcgccaccacacctggctaatttttgtatttttgatagagacggggtttcaccatgttgtccaggctggtctcgaactcctgagctcaggtgatccacctgcctcggcctcccaaagtgccggattacaggcatgagccactactccgggcttacctccttcttaatctgaaatctacttctgttcctttcttctctgtgaattgcccttgttatttctccttcagctgtccttaccctcagatacgttttccgctgtcggccgcctcttcttcgtgtgctctctcccctcgtggcctcctgcctttctgacagctccttcttcctccactggccccttcttccctctctgaggctcaggcctcagtgtctttccggtctccctacacactcccatgaagaccctctccgcattctgacttcggtgccaccctttatgccggagactcccagatctcatttccggatctgcctccttaacttataggtctggatacttcctgtttggtttttcaccttcatgctaaacgcagtttgtctaaatcggaagtcaacttccattctctgccgcccctccctcctgacccatgttggatcattccgctaatcacagggacccaaaagcttcgagtcacttttggctcatctcgtcctgttgaccctcatctgaggcttcagtgcaaggtttcctttttccattgcttcctcttcttggaacccagaaactgccgatgggtctttaattcttggagtctccttctcagcctcatcgctcaactccttcaggaacccaatggctcagccaacccaggtgggcaccaacacttgaatacactccagtctctccctcttctgacccctttactttctgcactgctgctgctgctaccttgcctgagatattcctccctcccagactcttcactccccttcccactgctgaggagctccccttccttgaccggccagctcacattctgtcttcatcataaagcgctctccctcttcaagaagcaggaactggccagttcctgcttcttgacatctacttccttggtttctcttattttcttctctggctatccttcctgctatccttttcttctctagctgttccttctcaaattcattcatagacttc

SEQ ID NO: 46556 - DNA, 801 bp, Homo sapiens
ggtcaggccttcttggctgatcatctgcctttgtggctgcagcccctgtggctgctgccaccacagctgctcctgctgctgctgctaccttgcctgagatattcctccctcccagactcttcactccccttcccactgctgaggagctccccttccttgaccggccagctcacattctgtcttcatcataaagcgctctccctcttcaagaagcacattcagctaacagcgctctctgccagtcgttcatagtttgcatccctcccaggccttagcattttctgccttatattattaaggtttttttttaaccatgtctttttatttatttattttagagatggggtctcgctttgttgcccaggctagtctcgaactcctgggctcaaacaatcctcctgtcttggcctcccaaagtgttgggattacaggtatgagccagcatgcccgttctataagcaggtcttctcaaatgtaacctcctcaagggcagacgtatctgtaaccccctagcaagctgcaccagctctgacacgtacttgatgctcagcgatgcatcacactgatttcctgccactggactgtgataccagactcagggctcccagccatcacatacagctccctcagccacgacaccccaatacagggatttaaaatctgccttcataatttacttgtggccgggcgtggtggctcacacctgtaatcctagcactttgggaggccgaggcaagtggatcacctgaggtcaggagttcaagaccagcctggccaacatggcaaaatcccatctttact

SEQ ID NO: 46557 - DNA, 2569 bp, Homo sapiens
  misc_feature (1579)..(1579): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagccctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46558 - DNA, 4403 bp, Homo sapiens
  misc_feature (1671)..(1671): n is a, c, g, or t
  misc_feature (3039)..(3040): n is a, c, g, or t
  misc_feature (3467)..(3467): n is a, c, g, or t
  misc_feature (4047)..(4047): n is a, c, g, or t
  misc_feature (4082)..(4082): n is a, c, g, or t
  misc_feature (4087)..(4087): n is a, c, g, or t
  misc_feature (4090)..(4090): n is a, c, g, or t
  misc_feature (4096)..(4096): n is a, c, g, or t
  misc_feature (4111)..(4111): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaataccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgaggtgggaggatcacttgagcccaagagtttgaagctatggtgagctatgattgttccactatactccagcattggcaacagagcaagaactcatctctaaaaagtaaaaagcaactccccagaaagactgtatttctacagataaatattgcattgagatgccaaatagagtgttgttgtaaagtcatcagactagaaagcagacctggggacagtgtttaccacctaagaggcagtcctgtttttgagacccacatctatatatagagatttttgtttgtttgtttgtttgttttgttttgttttgagatgaagtctcactctgtcacccaggctggagtgcagtggcgcnntcttggctcactgcaacctccacctcccaggttcaagcaattctcctgcctcagcctcctgagtagctgggattacaggtgcgcactgccacgcctgactaatttttgtatttctagtaaagatggggtttcactatgttggccaggctggtcttgaactcctcacctcaggtgatccacccatctcagcctcccaaagtgctgagattacaggcgtgagccaccacgcccggccagagatccacatctatatttataacacatttatggatgaaaattaaaccaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctacccaacaagagcgaaacaaaaaacaaaaaacaaaaaaaaaaaaccaccaaatccttttttttantgtagtagggtttatatagatatactaatataatngcttnggngaattngagtatgtatggagnccacacatactgtgatataaagtgtatatacagatattcggatatttctctagttgcactgatgattacgagaaccagactgggaaaatacaatctccaaacgtgatgtttatcctggaattacccaatttattacgcagtggctcacttcacataactcaatggacggcagagcggctgaaagaaaaactcggtcacgccaccccctcgggcacgcggggagtgcccgctacaaacagggaaaagagcgcttaaaaacagggcggacccacaagaaggcataatacaacaa

SEQ ID NO: 46559 - DNA, 3485 bp, Homo sapiens
  misc_feature (1671)..(1671): n is a, c, g, or t
  misc_feature (3039)..(3040): n is a, c, g, or t
  misc_feature (3129)..(3129): n is a, c, g, or t
  misc_feature (3164)..(3164): n is a, c, g, or t
  misc_feature (3169)..(3169): n is a, c, g, or t
  misc_feature (3172)..(3172): n is a, c, g, or t
  misc_feature (3178)..(3178): n is a, c, g, or t
  misc_feature (3193)..(3193): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaataccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgaggtgggaggatcacttgagcccaagagtttgaagctatggtgagctatgattgttccactatactccagcattggcaacagagcaagaactcatctctaaaaagtaaaaagcaactccccagaaagactgtatttctacagataaatattgcattgagatgccaaatagagtgttgttgtaaagtcatcagactagaaagcagacctggggacagtgtttaccacctaagaggcagtcctgtttttgagacccacatctatatatagagatttttgtttgtttgtttgtttgttttgttttgttttgagatgaagtctcactctgtcacccaggctggagtgcagtgagccnnggtcgcgtcattgcactccagcctgagcaacaagagcgaaacaaaaaacaaaaaacaaaaaaaaaaaaccaccaaatccttttttttantgtagtagggtttatatagatatactaatataatngcttnggngaattngagtatgtatggagnccacacatactgtgatataaagtgtatatacagatattcggatatttctctagttgcactgatgattacgagaaccagactgggaaaatacaatctccaaacgtgatgtttatcctggaattacccaatttattacgcagtggctcacttcacataactcaatggacggcagagcggctgaaagaaaaactcggtcacgccaccccctcgggcacgcggggagtgcccgctacaaacagggaaaagagcgcttaaaaacagggcggacccacaagaaggcataatacaacaa

SEQ ID NO: 46560 - DNA, 3624 bp, Homo sapiens
  misc_feature (1671)..(1671): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaataccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46561 - DNA, 2631 bp, Homo sapiens
  misc_feature (1671)..(1671): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaaaacaacaaaaagaacatacaaaaacattttgggggggtctgccgccccagagaaaaacgatgtcaaaagaacacacatctatagggcgaacgcacgcccacaggaacaagtcccaggaagaaagcctgggcccagggatgtctacaacgaagaaaaccccggggcacaaagaagcgagcacagaatcccaccataaaagacacccccggggggcaacacgatggtcagaaaaccaaccgcacagggccagcgggaggccaagggggatccaaacaggtgcccaagagaggccgtataaag

SEQ ID NO: 46562 - DNA, 2653 bp, Homo sapiens
  misc_feature (1663)..(1663): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccacccatctcagcctcccaaagtgctgagattacaggcgtgagccaccacgcccggccagagatccacatctatatttataacacatttatggatgaaaattaaaccaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46563 - DNA, 2257 bp, Homo sapiens
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46564 - DNA, 1841 bp, Homo sapiens
  misc_feature (1629)..(1629): n is a, c, g, or t
  misc_feature (1661)..(1663): n is a, c, g, or t
  misc_feature (1667)..(1668): n is a, c, g, or t
  misc_feature (1700)..(1701): n is a, c, g, or t
  misc_feature (1746)..(1746): n is a, c, g, or t
  misc_feature (1752)..(1752): n is a, c, g, or t
  misc_feature (1756)..(1756): n is a, c, g, or t
  misc_feature (1820)..(1820): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccacccatctcagcctcccaaagtgctgagattacaggcgtgagccaccacgcccggccagagatccacatctatatttataacacatttatggatgaaaattaaaccaggtgtccgggtgcggttactcatgcctgtaatccgagcacttgtggaggccgaggcaggcggattacttgaggtcaggacttcgaaaccagctggtctcaaactcctnacctcaatttatccacctcccccccccccccnnnctannaggataacaggtgtgagccgccgtgccccgcnnaaaatttttcttaattacaataaatattcagcattttttctaatnaaaatnaatnttatttaccagtaaaagtatgcattttaaaagactttcagatttatgctttttacgtgaagctnctaaactaaaaataaattgaa

SEQ ID NO: 46565 - DNA, 1236 bp, Homo sapiens
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggggaagggagctggtggaagggaggctggtggaggggaggctggtggaag

SEQ ID NO: 46566 - DNA, 4457 bp, Homo sapiens
  misc_feature (1671)..(1671): n is a, c, g, or t
  misc_feature (3039)..(3040): n is a, c, g, or t
  misc_feature (3467)..(3467): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaataccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgaggtgggaggatcacttgagcccaagagtttgaagctatggtgagctatgattgttccactatactccagcattggcaacagagcaagaactcatctctaaaaagtaaaaagcaactccccagaaagactgtatttctacagataaatattgcattgagatgccaaatagagtgttgttgtaaagtcatcagactagaaagcagacctggggacagtgtttaccacctaagaggcagtcctgtttttgagacccacatctatatatagagatttttgtttgtttgtttgtttgttttgttttgttttgagatgaagtctcactctgtcacccaggctggagtgcagtggcgcnntcttggctcactgcaacctccacctcccaggttcaagcaattctcctgcctcagcctcctgagtagctgggattacaggtgcgcactgccacgcctgactaatttttgtatttctagtaaagatggggtttcactatgttggccaggctggtcttgaactcctcacctcaggtgatccacccatctcagcctcccaaagtgctgagattacaggcgtgagccaccacgcccggccagagatccacatctatatttataacacatttatggatgaaaattaaaccaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46567 - DNA, 4209 bp, Homo sapiens
  misc_feature (1423)..(1423): n is a, c, g, or t
  misc_feature (2791)..(2792): n is a, c, g, or t
  misc_feature (3219)..(3219): n is a, c, g, or t
tccgggccacagccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaataccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgaggtgggaggatcacttgagcccaagagtttgaagctatggtgagctatgattgttccactatactccagcattggcaacagagcaagaactcatctctaaaaagtaaaaagcaactccccagaaagactgtatttctacagataaatattgcattgagatgccaaatagagtgttgttgtaaagtcatcagactagaaagcagacctggggacagtgtttaccacctaagaggcagtcctgtttttgagacccacatctatatatagagatttttgtttgtttgtttgtttgttttgttttgttttgagatgaagtctcactctgtcacccaggctggagtgcagtggcgcnntcttggctcactgcaacctccacctcccaggttcaagcaattctcctgcctcagcctcctgagtagctgggattacaggtgcgcactgccacgcctgactaatttttgtatttctagtaaagatggggtttcactatgttggccaggctggtcttgaactcctcacctcaggtgatccacccatctcagcctcccaaagtgctgagattacaggcgtgagccaccacgcccggccagagatccacatctatatttataacacatttatggatgaaaattaaaccaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46568 - DNA, 3185 bp, Homo sapiens
  misc_feature (1671)..(1671): n is a, c, g, or t
  misc_feature (2739)..(2740): n is a, c, g, or t
  misc_feature (2829)..(2829): n is a, c, g, or t
  misc_feature (2864)..(2864): n is a, c, g, or t
  misc_feature (2869)..(2869): n is a, c, g, or t
  misc_feature (2872)..(2872): n is a, c, g, or t
  misc_feature (2878)..(2878): n is a, c, g, or t
  misc_feature (2893)..(2893): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcaggtggatcacctgaggtcaggagtttgagaccagcctggccaacatggtgaaactccttccccactaaaaatacagaaattagctgggcatagtggcgggtgcctgtaatcccagctatgcgggaggctgaggcaggagaattgcttgaacccaagaggcggaggttgcagtgagccngggtcgcgtcattgcactccagcctgagcaacaagagcgaaacaaaaacaaacaaacaaacaaaaaaaacccacccaaatccttttttttaatgtagtagggtttatatagatatactaatataattgcatttggagaattagagtatgtatggagcccacacatactgtgatataaagtgtatatacagatatttggatattttctagtttgcatgatgattaagagaaccagatgggaaaatacaatctccaaagtgatgtttatcctggaattacccaatttagattagagaggttgttcaaatttaactagataactctagtttgtactgtataggtgcagttatgacagtaaaaaaatagcctcttggctcatacctgtaatcccaccactttgggaggccaaggtgggaggattgcttgagcccaggaattcaagactagcctgggcaacataatacagggagaccccgtttctattaaaaatacaaaaatcagccagctgtggtgacacatgcctatagtcccagctacttaggaagctgagaagggaggatcacttgaggctgtagtgcactataattatgcctgtgaatagccactctactccagcctgggcaacatagcaagaccccatctctaaaaattaaaaaaaaaatttaaattagaatatcatttctagcatcttaggtaggtacttatatctggcttacagaagtctaaggtattccttatttttatatctgctgtccacatttatacagctacataaaaattttatgacaacttcaacatgaaccttatattttcgacaataccttgccaaggaatctctgaagtccatagcaggtcactgtgagacctagttccctgttgtcactgacctatgtaatcaaagacagtaatacagcctgggaaacatagcgagaccctgtctctatcaaaaatttaaaattacccaggcatggtgacgcacacctgtagtctaagtgtccaagttacttgtgaagctgaggtggggcaggagaattgcttgaacccgggaggcagaggttgcagtgagccnnggtcgcgtcattgcactccagcctgagcaacaagagcgaaacaaaaaacaaaaaacaaaaaaaaaaaaccaccaaatccttttttttantgtagtagggtttatatagatatactaatataatngcttnggngaattngagtatgtatggagnccacacatactgtgatataaagtgtatatacagatattcggatatttctctagttgcactgatgattacgagaaccagactgggaaaatacaatctccaaacgtgatgtttatcctggaattacccaatttattacgcagtggctcacttcacataactcaatggacggcagagcggctgaaagaaaaactcggtcacgccaccccctcgggcacgcggggagtgcccgctacaaacagggaaaagagcgcttaaaaacagggcggacccacaagaaggcataatacaacaa

SEQ ID NO: 46569 - DNA, 2535 bp, Homo sapiens
  misc_feature (1545)..(1545): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcacacctgtaatcccagcactttgggaggctgaggcagcctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46570 - DNA, 2707 bp, Homo sapiens
  misc_feature (1717)..(1717): n is a, c, g, or t
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctcccaggttcaagcaattctcctgcctcagcctcctgagtagctgggattacaggtgcgcactgccacgcctgactaatttttgtatttctagtaaagatggggtttcactatgttggccaggctggtcttgaactcctcacctcaggtgatccacccatctcagcctcccaaagtgctgagattacaggcgtgagccaccacgcccggccagagatccacatctatatttataacacatttatggatgaaaattaaaccaggtgtccgggtgcggttactcatgcctgtaatccgagcacttgtggaggccgaggcaggcggattacttgaggtcaggacttcgaaaccagcctggccaacatggtgaaatcccatctctactaaaaatacaaaattagccnggtgtggtgtcacgcacctgtagtcccagttacttgaacctgggaggcagaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 46571 - DNA, 1536 bp, Homo sapiens
ccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatgtaaggaactgcacagtactatgctctactactacttaaaagaatgatattgttgtacaaaggcctaaagaaaaggaacacaacccccaccaatttaaacaaaaaaaaaaaaaaaaccaaaaaaaacccctgtcggcgcgaccgcaccagggccccagaaggaaagctcttaaacaccacccggttggggccggacggcccccgtaggtactgactggcaccggggccacaaggtccgcagagaagacacccgcggcgacaacgaggcccggtctccacacgaataatagcgccgggcggaccccacgttcgtcgacaaaaccgagagggaccggaggcccacagggtaccaccgagggcacagagccgatacaaatgcc

SEQ ID NO: 46572 - DNA, 352 bp, Homo sapiens
cagaatctctctgaccttctcttgccttcctttcacttccgcaaggcagaactgtgggtcatataaacccttattccagagagggtcctgctccatatgctgggggaaagaatgccaacttaatgaagcatccataaaaacccaagaggactgggttccaagagcttctggatagctgaacacatggagggtcctggagggtgacacaccccgggaggactggagagctctgtgccccttccccaatactgtgccctatgcatctcttcatatgttatcctttatgattttctttgcaataaactggtaaacgtgtttccctgagttctgtgagctgcaccagcaaattaat

SEQ ID NO: 46573 - DNA, 536 bp, Homo sapiens
agaaaaaaagttaatgagttctattttggaaatgtctgtagaatatccagttataggtaggcttttgtatctataggtctggatttagacatacaaatctgtactagggctgtagttttgagaattaacagtactgaattaaagtggtagaagccttggacattgacagagttcatatagaatgagaacaagatgaaagataccctgggagataaagaacaggtagattagcttttgaaagatatcgagaagtgatttaaaaaaattagagaatcaggaaagtataataagaaaagccaaggtgatagaacattttaaaaagaaggtggtgatcttcagtgccagatgttgcaaattggtcaagaagaatgaggactgaaccaggtgtggtggcttatgcctgtaattccagctactcagcaggctgaggtagaaggattgcttgaactcaggagttagaggctgcattaagccatgataatgccactgcactcaggcctgagtgaaagagcaagaccctgtctgtaaaaaatcag

SEQ ID NO: 46574 - DNA, 545 bp, Homo sapiens
atcaagtcagtggttgccagtggatggggtgaggcaagagggaatttgggggaatgaaattgtcctgtaactagattgtggtagtagttacatggttatatacatttatttattttgttttattattgttttcttattatttgtttgtttgttttgggatggagtcttgctctgtcacccaggctggagtgcagtggtgcggtcttggctcgctgcggcctccacctctcgggttcaagtgattctgtgcaccaccacggccagctacgttttgtgtttttagtggatggagacgggttttaccatgttggccaggctggtctcgaacccctgacctcaggtgatctggcagcctcggcctccccacgtgctgggattataggcgtgagtcaccatgcccagtcgtttatacaacatttatccaaaactcactgcatcataaaattgcaagagtaaattttactgtatgtaaatatcttaattttttaaaggaaaaaaaaagtccaaaataagtagctataattaccttttccttttagaaaaag

SEQ ID NO: 46575 - DNA, 885 bp, Homo sapiens
gtaagacagattttcaccaacagagagcgtttctatctcttctctactcctcccttttaaaattgagattctgacagtgtaaaggagttaggacccccttttgggattccggcatggttttgtggctttaaaatgctttaaaattgctgaagtttcttggtattggaactgtttctcctaagtaacattttatcatcgcacgtgaaatactgtaactctcggtgccaaatccaggaaaaatgggcggttaggagaagtccagggaaagccgactgagcaggttgtgaaggtaagcagtcctgttaaatgtacacaaaaatgtcactttgcttctctaaactaggaaaactgatagggacttttggaataaggtaggatataagatttaaaaatataaataggtcatcccctccaaaaaagccgtttgtatgtttaactggtgagtgacagatctgtaataattatttagaaataggaatgtcgaggcgggcggatcacctgaggtcgggagttcgagaccagccaggtcaacatggcgaaaccctgtctctactaaaaattacaaaaattagctggatgtggtggcatgagcttgtgatcccagccactcgggatggtgaggcgggataatcccttgaacccgggaggcgaaggttgcagtgagctgagatggcgccactgcattcccgcctgggcgatagagactacttctaaaaaaaaaaaaaaaaagaaaagaaaagaagtagggatgtttgaagaacacagttttgcagtgagcaagttgtacccactctagtgaggacagtgacctcagaataattgagagggatcatttgaccttgagaccccaggacctaacaaataaacactatcattggctagaat

SEQ ID NO: 46576 - DNA, 325 bp, Homo sapiens
tttaatttgaggagtccccactgacctggccaaagcattcttggaaccatgctgcagtctctttctaccccaatcagccttccttccctctttccctctacaggtataagatctgaaccctagtctgaagattcttcccaccttctcccacttcctcctccttcactcttgcaaatttaattccatggcggtgtttgccctcagcagatctagagcttaattcaagtcatatgatcagataagatgaaaaataacttaagatgtcgttcataacaggtgagtgaacagctatgcatggcggtagggaggagagaattctgatcga

SEQ ID NO: 46577 - DNA, 125 bp, Homo sapiens
ccttgactaagaaaacccaaagacagtctaggacagccagatgctagaaaagtttatttgtattgtgaattttaaaaaattcatccacagcaagtaagggagtacataatggaaaaagccgctgg

SEQ ID NO: 46578 - DNA, 325 bp, Homo sapiens
cttgaacctgggaggtggaggttgcagtgagccgagatcatgtcactgcactccagcctaggtgacatagccagactgtctcaggaaaaaaataaaaataaataaagaatcttgaattatattttttaatctaaaagtgtcttaatgttaaatttttgtatgtatacatatatcccctcccaacactgacaagatcaaataaaacatgagagtgggccgatttggctctcaggtgaaagacaatcagaggagctggctgaattaccagaaaggactaagaggtagtagggtttggcttctaaaaatggcaactgagctgggcaca

SEQ ID NO: 46579 - DNA, 397 bp, Homo sapiens
acaacttgtaagtttactagatttattagctctttaaaagtttaggaggtagacggaattttttttttccgctcaacatactgaaagcctttaaattaaacttactctaggtaaattgctttgtaccttttacattgccttgtacatgccttacctttgttgcgtgtttgatttcttttcctgtagtctactgcctttcgctaggcaggtttcctcacagcattatttcttagaattgtgaggagactagtgatactgcttttcatgtatgcctttactaaagcatctaattcatcatatgggcagttaataagtatgaattgatgagatgacagtcgtgtattttttactcttcagggaaagaaagaccttgtgctatcccttccaatttctccct

SEQ ID NO: 46580 - DNA, 463 bp, Homo sapiens
gctctgtcccggcctggtggctgctcactgtgggatgctgtgcgattagacagttactatctttccctggttgacggattagagtttcccttttctgagcatcttgttttgaagtgatccgaagtgtttagggttaaagagcgtgattttcccaaactgtccaaagaaatagaagcaggtctgcaagaggggggtgcccagagccttgagatggaagcgagatggggtgagacctggggagctctccaggccgccgggaagctgcacgtcatcctctggacctctttgctgactgtgtgctgtcaccacagcagccaccttctctcatctgtaaacaggattttacgtaaatttccatacacttggttgttgacaattaagtagattgtttttaaagatacttgaaatgatatcagaatttcctaaatatatcattaaaacaggaaacttagttacctactca

SEQ ID NO: 46581 - DNA, 411 bp, Homo sapiens
aatatcaagtctttattcataagaatgcttacaacttttcttggcagacatggatttctctaaccaatttttctcccatccaagtactaaccaggcccaatcctgcttaacttctgagatcagatgagattgagagtgttcagggtggtatggccatatttgctaaccaatttttctttttaaatttccttttttttttttttttttttttgagacggagtctcactctgttgtccaggctggagtgacagtggcatgatctcggctcactgcaacctctgcctcccaggttcaagcgatcctcctgcctcagcctccatagtagctgggactactgccgtgtgtcaccacgcccagccaatttttgtatttttagtagagacagggtttcaccatattggcgaggctggt

SEQ ID NO: 46582 - DNA, 426 bp, Homo sapiens
aaatgcacattttgctatttggattggatgctgctggcaagatgaccattctgtataaactgaagttaggggagatagtcaccaccattcctaccactggttttaacgtggaaacagtagagtataagaacacttgtttcacagtacgggatgttggtggtcaagacagaattaggcctctctggaagcattacttccagaatacccagggtcttatttttgtggtagatagcaacgatcgtggaaagaattcaggaagtagcagatgagctgcagaaaatgcttctggtagatgaattgagagatgcagtgctgctactttttgcaaacaaacaggatttgccaaatgatatggccgtcagtgaaatgacagatgcggccgaaaatttataaaccaccttctttgatacacgccccgaccccgcg

SEQ ID NO: 46583 - DNA, 627 bp, Homo sapiens
aatgtcctttaagatgggttagaattcactccttctttgaaaaatgttaattgaagtctactgcacaaataataggtctatgtattttttcagagtattttgcatttttccttaattatatgacagatttagtttagtatgtcccttctttccatttctcttccttgtttttagcttttgaacattttacctctgtgagaatcagaggtggtaacattttacacgttctttgatcagcaaatgatttacaggtgacttggtttaaaataactagatgattctcaactttctcatttttcttcatcttggcattataagatgtctgatttcctttatttccatagtgacactgaaatgactgctctttggtacagttctctaagggttaagtgccagaaagccaaggtaaaactttctgattgggttcagctccacagcttctgtcccacaaacatctgtctcttctagcccctatttctatctaagatgagacggaaacaaacttcctgactgtatcctggagtttttgtttagtatttgtgttagttttagggtgcttatgaaaattcctgtgtttggcaaggtcaagaatgggtccttttgaaaatatgaacaagataagacaca

SEQ ID NO: 46584 - DNA, 417 bp, Homo sapiens
tactttttgaccaactctctgcccttagattcctattatagaaaatagggacactccacctactacagtgttagaggctaaatgagacaatgaatgtaaagtgcccagatgggtttggcacatagcagacactgagtatctattgtttacttgttcttccaaactgccaatcagcaggtagagcaggagttgtctcctttctaaagatgaaaccagctcagagacgttagcttgatcaaggtcacacagtaagtggcagaggcaaaacccaaacaagggcctcctgaccccctgatcctaggttctgtccagccctgcctccctaatggggcactggacgtgggttggatgccactttcgcagagctggcaccagacttacaaagccccggcaggggaagccactttacaaccagcc

SEQ ID NO: 46585 - DNA, 673 bp, Homo sapiens
cagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaac

SEQ ID NO: 46586 - DNA, 475 bp, Homo sapiens
gattttgcagctattgaaggactttagctcttcggattccttggggttggggcaaggggacttgttaggaaacgtgctcagcgagcaaactgttgttgtgcactggtaaacagtttgcttttcagacacgcctggataaaacttgagctgtcctctgcagaggtgcctcttgtgtgttcagcgaacggtgggctgaacggtcatctttcagcagattagctgaaagaacatctattgctgggctcagttgttcagagatctgcgcaccctttgtgcaagagcagggaaaatttgtgttatgacaatggctgacagaatgtttaattaaagctgcaattggcagtaactaaattctccgaggtttctttcctctcctctttgctactgaaaggtgcagaaatgcttttgacagcatctttcctactgacagatgaattgttttgacaggagaatttgaaaccttcaactgaagaca

SEQ ID NO: 46587 - DNA, 454 bp, Homo sapiens
attctccagggccagactctcgagggccttgaatgctaggccaggccatttcatgtattttatttgttctggctttttttgtgtatgattttggtagcccattgagttttacttggtgcttttgagcctgactgatgtggtcgaagcatgctgcgtctgatgactgtcatgcatttaaatgaacctgaggtgaaagaatctgaatttaggtaatagaccaacacatagactacctgattgtggcagtagagatggaaaaagaaggacttaatggaggtgaactttgaaaaaaaaaggaattgaagtatgatattgagagaacataattcaacattgaaatggtgtagtatgaaatattagcaggaactgtgttattacttctgtgcatgtagttagttcctatcaacatggcaaatatttagtatgtatcatttgtgtggtttatattttatac

SEQ ID NO: 46588 - DNA, 396 bp, Homo sapiens
attctccagggccagactctcgagggccttgaatgctaggccaggccatttcatgtattttatttgttctggctttttttgtgtatgattttggtagcccattgagttttacttggtgcttttgagcctgactgatgtggtcgaagcatgctgcgtctgatgactgtcatgcatttaaatgaacctgaggtgaaagaatctgaatttaggtaatagaccaacacatagactacctgattgtggcagtagagatggaaaaagaaggacttaatggaggtgaactttgaaatatgaaatattagcaggaactgtgttattacttctgtgcatgtagttagttcctatcaacatggcaaatatttagtatgtatcatttgtgtggtttatattttatac

SEQ ID NO: 46589 - DNA, 454 bp, Homo sapiens
aaaatatttaccttcctagactcccttgcagctagatgaaggccaggtgacattgtcttgtcaatgaaatataggcacaaggccctatgcaggctgtccctttctgaataaagcctgggtaaaagaaaacctgagtctcttccccctttcttctttcctgaatgcacagcagccatgctgtgatcacttggacaaaagccacacaccacagatggcagagcaggaagatattcagcctgattcctgaacatcctttgtgcagctacttcagcctgggttgcctgccttcacccatcttgttacagaagaaaaagacacctctcacttgtttaagccactgaagtagtttttttgtaattgtgtttgttgttgttgttgttgctgttaactaaaaattaatacaatcttactcaatagatctttattaataaaaatcctgaaatgtaagtataaa

SEQ ID NO: 46590 - DNA, 289 bp, Homo sapiens
ctaatttccattctctcaggctctccctaggaatttagaaccttcttcaattcactgtacaaaacaattagctttctaatttcctattttatttttttttactctgtatgaggtctgcctcaggactgaaaaccatttaagttgtgctagtaaaccaaaaataaaggatttcagattacactctgtcaaaaaaaaattctcatctcaaagagcgttcaaacaattatgcaattatacctcatgatgagtgctatgaaaaaatcttaaagcgtaagaatagagaattagg

SEQ ID NO: 46591 - DNA, 340 bp, Homo sapiens
cgtgtctcctgattttaagtctaatattcttttttcatcacaccagccataaactgaaatgagcttgtatttcttagatcctgttttaaataattgactatttgatatgaaacagtcaatagttcttttctagatatttctgctgttctttttatttttctcagttaccataaaaaaataaggaagataattagaatgatagagttttacacctggatggaagatggaattttgtaaagcaactaattcaacttgttcattttatttatttatttatttatttttgagacggagtcttgctctgttgcctaggctggagtgcagtggtgcaatctcacct

SEQ ID NO: 46592 - DNA, 1268 bp, Homo sapiens
  misc_feature (48)..(48): n is a, c, g, or t
gaacatgccgtggctcggtgctagagtcatagcgggcacttctgtgtngtccgttgtcatcgcagtgtctgctctgcgggtgctggggcctgtgttggttaagactgacttggtgggggacgctgatgatgggggaggctgtgagtggtggggatgggaactccagactctccactgcagcttttttttttttgaaacacagtttcacttttgttgcccaggccagagcgcaacggtgcgatctcagctcactgcaaactccacctcccaggttcaagcaattctcctgcctcagcctcccgaagtgctgggattacaggcatatgccaccacacctggctctaagagagtattataacataatggttaaacttgcagattttggactcatacaggcctgggttcaaatcccacccagggcactggctaaatggttctatgagctacttttctgtagaacagacccctagaaatagaactatttgctcagtgtgattcttttaaatgttaactttaatagatattgccaaattgtcctccagaattatctcattatttttatatgcacaaccacaacctataagagaagatattaaattcttgatagctttcttatctactgcctcagcacactgaaaaatttaaactactacaaatacaacataaaataaatttggcactccttgacaactaaatgcccttatttttgtaatccaatttctcctcctttcttgttgactatagaaaaagaatgtagaatcatttaatttaaattgtctctaactgacctgatccaacctctgcagccaaatctgtttttcactcttatatttccattatgagagtcaaactttccaatcacccaagctaacaaaaaaataacaataatgaaaagggagaatcagcttttactcctctttcaccattcctatccagcctgtaggcaggtcctgttggttctacctgtgcctccttcctctacccccaaactcctttccctttgagtgagacctgcctaatttaggttgtcatcctctctgactagcatatgagactttcttccaatttgttttctgtctacttggatttttttcactcttgccaattttgtctgtctatctctattagccttgaagggctccccaaagagggaactctgtcttcctcacctttgactccttatgccagtacagtgccaggcacaaagcaaatgctcaggaattgtggaacagaactgaccatttgttgccactttattattctaagat

SEQ ID NO: 46593 - DNA, 323 bp, Homo sapiens
ttctacaggcagttgaaaacgtgtaacttctttaagttttaagtgtaaaagattggtcaccagactgttggcatgaccaactgtaattatacaggcttgtttctgttccgttttattctcttaacagtatatggctgatgcaggttccaattctgttggtcagacaccatctatccactggaaggctagctacataaaaaagaaagagcagcaatatactaggatagaaagagaggggagagagagagagcaaaggcctatgacataaacaaacaccctgtgagtttttaaaaatagtttttgaataggtaatacatttatat

SEQ ID NO: 46594 - DNA, 566 bp, Homo sapiens
acctaggaagtaagcaattttgaactatcatatgccaacgttttataacaacacaagatgacaaagtatctatactttaatcatttttagcaattaatgggtcagtattctaacttacttggaaatggctgacatttcaggaatgttacttaatcatatgactttaagattatgttactttgagatttttgaaactatgaagagtttatttaaaacctttaactcatttactttcacctaatttacttgttcttaaaaattatgcttcaattggtcgttaaacaaagctagccactatctcaagttatttccttgttaaccatttttacagtatgccaatgttagttgctacctaaacaagagccctaaagttaaatatgaggttattttgttggtcagaagacacactgttttattgaactagtctagtccacggttggctccggttccgatggcactcgagaggcctgcctggcaagacgtgtcggagccaccgcctgagctgctcggtctcaattccatatccacgcgtactagtagccaaccgtgactagtgggatcatcta

SEQ ID NO: 46595 - DNA, 704 bp, Homo sapiens
ctagaggatcctcagtttaagcgttcaggtgggaagtggcaggctggtgggaagaggccgtccccaccttcccctaaggcccacagtggagtccgctgaagctctgcatgacaggggaggtggctagtgtcgaggcatgcatagctgcccgtgtgcttgggaccacttccagggtgcttcccttgcaggtcccccatgggcctgcagctgggccaagggaacaaccccagcattacttaagctctcccagggcgcacctgcagatgtggggctgaacgagtgtggcaaggtcacacctctcggggacaggtgactccgtatctggacatccctgagtggtttgccctcagctctgccgaattctagcaagcgatctctttgcagtaatgttatatgtaaacatacctccttcctcccaggagagcagactattttcggatcaagttgtggtagaatctcttttaaaactctggactgtttgggtgatgttaaatccatgtcaacagcgtgcacccaccagatggaaactagacccaccagatggaaactagacccaccagaaggaaactaggagagtctcccagcagccccactgcacagtctgatccttgccgtcttgtgagctgccctcacggctctcgcaccagtgtgggttttgcacttgccgtcgccaccgtgtggccacacacactggttattggcta

SEQ ID NO: 46596 - DNA, 421 bp, Homo sapiens
gacccagtaggagaaagagaagtacctaggtgggaagtggcaggctggtgggaagaggccgtccccaccttcccctaaggcccacagtggagtccgctgaagctctgcatgacaggggaggtggctagtgtcgaggcatgcatagctgcccgtgtgcttgggaccacttccagggtgcttcccttgcaggtcccccatgggcctgcagctgggccaagggaacaaccccagcattacttaagctctcccagggcgcacctgcagatgtggggctgaacgagtgtggcaaggtcacacctctcggggacaggtgactccgtatctggacatccctgagtggtttgccctcagctctgccgaattctagcaagcgatctctttgcagtaatgttatatgtaaacatacctccttcctcccagg

SEQ ID NO: 46597 - DNA, 565 bp, Homo sapiens
tgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctgtaaatgttacccattttattccttaatttcctttatagacccctttccctgcaacacccagtagtctggcttctatcctgacaatgttagtgaagttgcttgcttgaaatttaccaggccaggcttatggctgtaatcccagaaactcaagaagctgaggcaggagaatccctatggtctcttgagtccaggagtttgagaccagcctgggcaagatagcaaaatactatctctacaaaaaaatgaaaaa

SEQ ID NO: 46598 - DNA, 405 bp, Homo sapiens
aaatgagactttggactgtggacttttgggttaatgctgaaatgagttaagactttgggggactgttgggaaggcatgattggttttgaaatgtgagaacatgagatttggaggggccagggatggaatgatatggtttggctctgtgtccccacccaaatctcatcttgaattgtactcccataattcccacgtgttgcgggggggacccagtgagagatcatttgaattttggggtggtttccccatactgttcatgtagtagtgaataagtctcacgagacctgatggttttatcaggggtttctgcttttgcatttcctcatttctcttgccactgccatgtaagaagtgcctttggtctcccaccatgattctgaggcctccccagccatgtggaactgt

SEQ ID NO: 46599 - DNA, 616 bp, Homo sapiens
gtcagaaagagaaacttccattgctaacatgaagccaaattgtcctaaacaggagtcttgagacttctcttcttttggtgtggattccggaactcctttctgaagcaagaggcaaatatctctcagcagagaatgccaagaccaatcacttaaccatggcaatcttactcagcatggtaattcccaccctgatggtcccaagatggctgcagcagtttcagccatgttatcctaatccaccaacatctggaggtatctgtcttttcaatctccatctattacaaatgtaggatacttttaccagaaggtcctcctctagactactactcatgtttcattggacaaatttggtcccatggaatttcttaagtcatttactgatgaggaaagtggaattatcatgactggattagactacctaagattcaccactcctgagcctggagaaagataattttctcagagcaaacaactgcatatggctgaagataggaatgaactataaaacaaaattggagtcctccaggaaagaaagggggaattaaagggaaatgattgtgtaggcaaaacacaatagtctccaatgccaaataaactttgttttgttactctctca

SEQ ID NO: 46600 - DNA, 717 bp, Homo sapiens
  misc_feature (679)..(679): n is a, c, g, or t
  misc_feature (695)..(695): n is a, c, g, or t
gtcagaaagagaaacttccattgctaacatgaagccaaattgtcctaaacaggagtcttgagacttctcttcttttggtgtggattccggaactcctttctgaagcaagaggcaaatatctctcagcagagaatgccaagaccaatcacttaaccatggcaatcttactcagcatggtaattcccaccctgatggtcccaagatggctgcagcagtttcagccatgttatcctaatccaccaacatctggaggtatctgtcttttcaatctccatctattacaaatgtaggatacttttaccagaaggtcctcctctagactactactcatgtttcattggacaaatttggtcccatggaatttcttaagtcatttactgatgaggaaagtggaattatcatgactggattagactacctaagattcaccactcctgagcctggagaaagataattttctcagagcaaacaactgcatatggctgaagataggaatgaactataaaacaaaattggagtcctccaggaaagaaagggggaattaaagggaaatgattgtgtaggcaaaacacaatagtctccaatgccaaataaactttgttttgttactctctcaaaaaaataaaacaaacgccctcgttgaactcagagatggaactatgcggcctctttcctttcngagggagaattatgancctcttcaactcccccctcccc

SEQ ID NO: 46601 - DNA, 378 bp, Homo sapiens
gtattaatgggcaggttacagctgtagtcaactgtggctcaatctaccagggtaccctggaagacaacacagaccatgcttcagtggtgctgggatgaggaagctggggtatatatcctccaattcccaactgtcatttgttggcgacattagctacccatacttctgccccatcccatgagtaagtcaaacacaatcctgtggaaagagaaagcccacaggatagtttcaagtgctgtcagcatatgtgagtggtgacacaaaggtgctataggtggggcaccaatagctctgccatacccctttccttactacaatggaatttcatccctttccttaagcaaacaggaggtttgtttcatatcacttggataattt

SEQ ID NO: 46602 - DNA, 338 bp, Homo sapiens
agaaagctgttaaaactgtatgtggtatggaaagacttcagggaagaggtaatctttgttctgagtctcaaagcatgagaggtttcccatcaggtgcacaggacgggaaaggatgtgcgatggggaacagacagataactacaatactgctgagtcttatggcccaggtctacaatgtcctatgagagcacagaataaggagtgactaaagctgagtaggaggtcagggtttaaagaaggaaataacgcttgagccgggttaaaaagactttaccaggctaagatagggaagaggcttttcagcagagtaaacattctagacaaggcacagagtcatg

SEQ ID NO: 46603 - DNA, 363 bp, Homo sapiens
tgggaagctataactttttaaaaaagtaatggttagtggcttttctcccttgagctttaaaaacagtgacaaactccagccttcccattttacagttgaagtaacagacttgtttgacattcttattaatgatagagattggtggagatttactttcaaggggatgggttttttcataatgggaaatactaataaaatttaaaatatacatctagatacagcatattgctgtaatacttgatttaggtagttttatagatttgctcagagatgcatcagctccctggtgtaaatgctgagttgtacaaaacaaatgtttttaaaatacttctctgcctcagtggtatggctttctctccagag

SEQ ID NO: 46604 - DNA, 317 bp, Homo sapiens
tttttagagtctagttttattctctttgctccctaaaacacactagcatcctcatttaaataattcaggtagaggaacagctgttgaggagttaatgattagataaagaaacagagtatggtcatttgaaaacactatttctgcaatgtgttaacattctgttaaaaagaatagccttgtaaggaactaggctgaagaataaaactatattaacatactccgaaggatgaaagagttcaggtaattccctgagggccaaaccctgagagcaagactagaatcacccaaggtatctgattaaccataatttacaaaca

SEQ ID NO: 46605 - DNA, 266 bp, Homo sapiens
accaattatttagaattcaggtgttattctagaattttgctgcagtatgacttttgtgctttcttctttagccttcacattacctttctgctacacatagggtcataaaggaaaaggaagaccaacactttttctttgacactgaagctttcatcagcagttttctggtctttttgcatgcattgttactctatgaattgaacatttcatagattacttttattttctcaagtttgatgactttcatttatcacaaatgatgcttg

SEQ ID NO: 46606 - DNA, 211 bp, Homo sapiens
ggaaacaatgctctcgaacctatgcctgcagctctgctccaggccgctcacacagtgccttccctaaaagaactcagccacatgggctacagggatgaagggttggggggaaacaaatccaggtgtgcgcttcgaccgcacgcgcctgcgccaaaaccccgcttggcccttagtttcagcctctgctgcagcgccttcgtccgcctccttt

SEQ ID NO: 46607 - DNA, 642 bp, Homo sapiens
tgacagtttataattaatttggctgtccatactaatattgataatagatataattgtctaagtaataggcttttaaaatgtttggcatgaaataatttgagaagcatttcccctttaaatttattttatttttttggagacagagcaaactctgtcacccaggctagagtgcagtagccaattactgctcactgtagctggctcctccgaggctcaggggatcctcccaccttatcctccccagtagctgggaccagaggtgtgcatcactatgcctgggctagttttactgttttttgtaggagatgggagtctgactatgttagtcagatcggtctcacactcctggggctcaagcagtcctcctgcctcagccttcccaaagtattggggattacaggtgtgagctgctgctccccagcctgaattttttgacgtcagtgttaatttgtgtgtgctatgttctgtctggatatattggactggtagcttgcaaacagcctaacccttggagataagttgattttaaattaagagtaattgtagtggataattgcagaggctcttaaaagagtaaatttcattttaaaaagaaggaaccaggagtaagaatgtaaaaataatacctacctttttatttgt

SEQ ID NO: 46608 - DNA, 402 bp, Homo sapiens
ctcaagcaatcctcctggcctcccaaagggctgtcattacagatgtgagtcactgcaaccagcctgaaatccagtcctcttgagctaaggttcatattgtatggttcacacctcaaatacctatgcctcaaaaactctatatcccagaaacaactggcaaaatgttgtatgatgtatttaagtaaatgttggaggagaataggtctacatttttcattataatctaactaaagtccatgacctaaaaaaggtaaagaaaattgatcctgactgggaaaaaaaaaatgacaacttcattccaaaatagtatataagaattaaatccagtaaaatgtcaaaataagtaataaattacctccaacacagaaggtagtatagtgtgctaaataatgtagattacct

SEQ ID NO: 46609 - DNA, 174 bp, Homo sapiens
cctaatggacctgtttatctctgctgttcatttgccacttcttttctgcaaaggtaaactctcattcacagactcgttaaccatgcttgctattctgggcttactccgtgggggtgtcctggagttcaggatcattcacaggggtcaggggtgcatcagggctaaatggggcta

SEQ ID NO: 46610 - DNA, 2002 bp, Homo sapiens
  misc_feature (1899)..(1899): n is a, c, g, or t
ttgtatggactcatggttttcaatatatagatagatttataagtatctgtaaagtatgtaataaatagctgtaatatgtgtagatatattttgctctttatctgtatatacatagatacagatatatttttttgccattacttttagtggcaaaaaccagaattacttttgcaccaacctaatatagctatatctacatcatctctatctctatttatatagagatagagaaagagtaaaagtaatggcaaaacctgcaattacttttgcaccaacctaatggatttagactctagcttccctcctgagagacagtagcagcagtaacacctagttatggactgaatgtatcccccaacaattcatatgttgaagctctaacccccaaggtaatagtatttggaggtgaggactttgggaggtatttaggtttagatgaggtcttaaggttggagcccacatgatgtgataagtgcccttacaagaagaggaagagacaccagagcattctctcaccctccgtgtgcatgcaccaaaaatggcatgtgaacacagagagaggaggcggctgcctacaagccaggaggagtgctctcaccaggaaccgaagctgtcggcaccttgatactggaccttccagcctccagaactgtgagaaataaatgtctactgcttaaaccacccagtctatggtatattgttatggcagctcaaactaagacaaccctaataatgagcacagctattgcccatatcttggcttctagatgccattctccactaaagaacccaaagttccttgaagaaatggctgatttcagggccaggacaggaagggaaaggggcaattaaaagtggaacatcttttgaagcaaaaagcaaggaagtactaaaaaaataattgggacataccaaatgggcacaaaagccagcttgaagagaaccccactggccaaatgtgggaaaatttgagaatcataataataaaggcaataagggaataaaataagaaatcatgagctaaataacaattaaaattttgatgaggaagggtatttacataatttcaaagtactttcccacaaagtacagttgaataatgaaggcaaaatgagtaatttacagtggaaaagcctggcagatgtcaccttcatcaagtgatgaattccaatgatattccattgcagtggaataaatagaaattttattccatttaataagatgaaatgacaaactacattgttactcttgttatacttctaacaaaactgcataacatgaatctaataatgaagaaaaaacaaattgagggacatgtcacaaaaataatatccaagtctcaaggtcatgaaagtcaaggaaagacagaggatctgttctagactgaaggagcttagagacatggcaactgaatgtagtgtgtggtcctgaactggttcctttcgccataaaagactaacattactgggacaattggcaaaacttgggtggagtctgaagattagatgctatcattgttaatttctcaactttgatggcttgttgtatttatgtagaaaatattttggttgtaagaaatatacatcaaggagtgaagcagtaacctattgattcaggaaaaaaaatatttttatagtaactccagcttttctgtaagtttctgaataaattaaacttaaataaagtttatcatctatttgttactggaactgcaatgcactttcatttcaagtcacttttttctttcaaatttggtaatggccacagccacaatcctgaagttatctactaagcattttaataattatgcccaagttggaaattcaagttgtccgaaaagacttaatttcttgtttcagtcaacgcttcccatcttcaaccagaggaactaaaaactanaaattttaaaatgtgttactctaaattaacaaagctatataaatgaaaaataaatgtaagtcattacacttttaaataaaacttgtttgaaacttttatataa

SEQ ID NO: 46611 - DNA, 310 bp, Homo sapiens
caggagaattgtttgaacccaggaggtagaggttgcagtgagctgagatcgtgccactgcactccagcctggagacagagtgggactccatctcaaaaaaaaagccgtaaagatcaagatcaagtagcactgggctaggcttatgtttctacctggcaaaaatcagctggagctgggtttcagtggggcattactggaggtgctattcagttcatcacagtcctttcttgactcagttccttgtgtgcattatgtgtctggtccctttaagtgttttaatttttgcctcctgacctaaaatggtagtttc

SEQ ID NO: 46612 - DNA, 2672 bp, Homo sapiens
tgttagaatctgatttcacctctcagcatccaccatgcatctcaagatagtcctggcgttcctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagatgtggagctacccaaggcacccatcttcctgtcgtccaccttcaactacaatggctctaccctggcagctgtgcatgccacccctcggggcttgcgctcaagggaacgaactacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttcatccctgaggtctcggaactctccaggtcctcttccccctcttcagttctcgccccagggttcccagtacagtgtgcaaggaaacctggtggtatcctccctctggtcatttacctttggccatggggtgttcagcggcctgaggatttttgatgttcggttccagggtgagcgaatagcctatgaagtcagtgtccaggagtgtgtatctatctatggtgccgattcacccaagacgatgctgactcgctatttggatagcagctttggactcggccgtaacagccgaggcttggtgcggggagtggactgcccctatcaagccacgatggtggacatccatatattagtgggcaaaggggcagtccagctgcttccaggggctgtgtgtgtatttgaggaagcccagggactgccccttcgaaggcaccacaattaccttcaaaatcatttctatggtggtttggccagctcagcccttgtggtcaggtctgtgtcatctgtgggcaactatgactacatttgggactttgtgttgtacccaaatggggcacttgaagggcgggtccatgccacgggttatatcaacacagctttcctgaaagggggagaggagggcctcctctttgggaaccgtgtgggggaaagagtgctgggaacggtgcacacacatgccttccacttcaagctggacctggatgtggcagggctgaaaaactgggtggtagctgaagacgtggtgtttaaacctgtggctgccccctggaacccggagcactggctacagcgcccacagctgactcggcaggtcctgggaaaggaggacctgacagctttttccttgggaagccccctaccccgctacctctacctggctagcaaccagactaatgcgtggggtcaccagcgcgggtaccgaatccagatccacagcccccttggcatacacatacccctggagagtgacatggagagggccctcagctgggggagataccagcttgtggtgacccagagaaaggaggaggagtcacagagcagtagcatctatcaccagaatgacatctggacacccacagttacctttgctgacttcatcaacaatgaaaccctcttaggagaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtgtactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattagaggaaatttactt

SEQ ID NO: 46613 - DNA, 131 bp, Homo sapiens
cccagagaccttacctggtgtggaactcatctcctttccctccccctggcagggctgaaaaactgggtggtagctgaagacgtggtgtttaaacctgtggctgccccctggaacccggagcactggctaca

SEQ ID NO: 46614 - DNA, 2591 bp, Homo sapiens
tgttagaatctgatttcacctctcagcatccaccatgcatctcaagatagtcctggcgttcctggcactgtccctcattaccatctttgccctggcctatgttttgctgaccagcccaggtggttccagccagcctccccactgcccctctgtatcccatagggcccagccctggccacaccctggccagagccagctgtttgcagacctgagccgagaggagttgacagctgtgatgcgctttctgacccagcggctggggccagggctggtggacgcagcccaggctcagccctcggacaactgcatcttctcagtggagctgcagctgccccccaaggctgcagccctggcccacctggacagggggagccccccacctgcccgggaggcactggccatcgtcctctttggtggacaaccccaacccaatgtgagtgagctggtggtggggccgctgcctcacccctcgtacatgcgggatgtgactgtggagcgtcacggcgggcccctgccctatcaccgtcgcccggtgctgagagctgagtttacacagatgtggaggcatctgaaagatgtggagctacccaaggcacccatcttcctgtcgtccaccttcaactacaatggctctaccctggcagctgtgcatgccacccctcggggcttgcgctcaagggaacgaactacctggatggccctctaccataacatctcaggggttggtcttttccttcaccccgtggggctggagctactactggaccacagggccctggaccctgcccactggactgtccagcaggtcttctaccttgggcactactatgcagacttgggccagttggaacgggagtttaagtctggccggttggaagtggttagagtccctctacctccaccaaatggagcttcatccctgaggtctcggaactctccaggtcctcttccccctcttcagttctcgccccagggttcccagtacagtgtgcaaggaaacctggtggtatcctccctctggtcatttacctttggccatggggtgttcagcggcctgaggatttttgatgttcggttccagggtgagcgaatagcctatgaagtcagtgtccaggagtgtgtatctatctatggtgccgattcacccaagacgatgctgactcgctatttggatagcagctttggactcggccgtaacagccgaggcttggtgcggggagtggactgcccctatcaagccacgatggtggacatccatatattagtgggcaaaggggcagtccagctgcttccaggggctgtgtgtgtatttgaggaagcccagggactgccccttcgaaggcaccacaattaccttcaaaatcatttctatggtggtttggccagctcagcccttgtggtcaggtctgtgtcatctgtgggcaactatgactacatttgggactttgtgttgtacccaaatggggcacttgaagggcgggtccatgccacgggttatatcaacacagctttcctgaaagggggagaggagggcctcctctttgggaaccgtgtgggggaaagagtgctgggaacggtgcacacacatgccttccacttcaagctggacctggatgtggcagggctgaaaaactgggtggtagctgaagacgtggtgtttaaacctgtggctgccccctggaacccggagcactggctacagcgcccacagctgactcggcaggtcctgggaaaggaggacctgacagctttttccttgggaagccccctaccccgctacctctacctggctagcaaccagactaatgcgtggggtcaccagcgcggataccagcttgtggtgacccagagaaaggaggaggagtcacagagcagtagcatctatcaccagaatgacatctggacacccacagttacctttgctgacttcatcaacaatgaaaccctcttaggagaggatctggtggcttgggtcacagccagcttcctgcacattccccatgccgaggacatcccaaacacagtgactctggggaacagagttggcttcttgctccgaccctataacttctttgatgaggacccctccatcttctcccctggcagtgtgtactttgagaagggccaggatgctgggctctgcagcatcaatcctgtggcctgcctccccgacctggcagcctgtgtcccggacttaccccctttctcttaccacggcttctagtcctgagggtgtggcgggcggcgtggttaggcacatgtacttttccctgtttctactttctattctccgtgtttttatcacacctgctccccagattcccaccccctcaatgttcctctcacacgaaacccccatcagtccctttggttaattcttacttcctgttcatctctaaagtgttaaattataaaaatgatttttaaatattcaaagaaaaatatcacaaatcctactactcagaaataggtggtcacattacatcagacatctctttatgcatgtgcattcaaaaggaagagtagatagaattttgtaaaacagatgttgtatgtaatttataataaaaagtattagaggaaatttactt

SEQ ID NO: 46615 - DNA, 1008 bp, Homo sapiens
gcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagtgaaggccaaggggcccccatcacaggccgatggggtaagacttcgagagagcctgatcctggggtcttctgagactccaccaggagccggagagggcagggagccaaatccagctaggaggttacagattgcttttcctgggctgggctcctgagtgttggttcttccagctgtgcacaggggatttcaaacgttctacgtcctaaagccaggaagagtgacaaggcaggtggggacagaaggaagaagccaggagcctccctgagaaggtgtcaccttatctgtcctcctcttccccacacactggcctctgggtcccccttctctgtccacccacagagtgaaaccaattaaaatgttggatctcatttaaagtctgggtga

SEQ ID NO: 46616 - DNA, 755 bp, Homo sapiens
  misc_feature (633)..(633): n is a, c, g, or t
  misc_feature (679)..(679): n is a, c, g, or t
gcactttgggaggccgaggcgggtggatcacctgaggtcaggagttcgagaccagcctggccaacatggtgaaaccctgtctctactaataatacaaaaattagccgggcatggtggcacgcgcctgtaatcccagctactcgggaggctgaggcaggagaattgctggaacccgggaggcggaggttgaagagagcagagattgtgccactgtgctctagcctgggtcacaagagcgaaactccgtctcaataataacaacaacaaaaataacccaggagtggctcaagagtccagtgtgggatgaaaatataaacagaggaagacaacatatgtcactggggaggctgggggagctagacaaaattcacacgggaggggcagggatgagacaatattgtgccctgggtctgtgcaaacgttgggaccagaatccactataagtttcattcttcggagacacggaagctctgcactggaggccgggactcaggcgtggaagagaatcttctccttattcaccggggaggctgtgtcttgtgcaaacaagtcatagaaacttgatgggagttggggagggactgaaggatgcatgcaaggttctgggaaggagtgagaagtagcagggatggntgtggagctgacaggtgaagaaagaaacctcctatcttgttggatnttaagattgtgaatgggggctagaaggagccccctgggggattatcaagcaggattggccaaggatggaggaaaca

SEQ ID NO: 46617 - DNA, 471 bp, Homo sapiens
atcatatcacgtgtgtttgttcagaaccttcagtagctcctttttttcacaagagagcccaggctccctagcccggcatccggggccttctgtgatctccttgcaaactccatctgcggcatggtttccagttctcgctagctttacgctttacatgcccttcgctgcagccagaccctctccgtagatacctctaatatcactgacactctcctgcgcgtgtgtccctgctccttttgctctgtgtgaaatgctttgtctcccttctccgttttgtatccatttattcattcatgtattctgcagccatggattgagtactatatttgtgccagaccctgggctacatattagatatatggtggtgacccaaacagctgcgattcctgcctttatgatctgttaagggaagagtcaaataataaataaaccaagagagacataaaagcataaattggggtgattatatga

SEQ ID NO: 46618 - DNA, 352 bp, Homo sapiens
gcattcagatgggagaccaagttaaatttcaaaactacaagtcatttttaaaagttatattaaaacaattttgtatgcatgtaagaataattataattagattggatttggtttagagaaaaatacaagcacaggattcatatatttcagaatcattttatgttaagctttgtttgaagtaaatttagggtacctggaatagtttgtccaaactcattgtaggacttaaaattcagattaacaattggcaaattcatatgtatgtactttgatcaatatgtatagtcctgctcaaggacggtagagagggagacacagggtcatggaattggaatgctgagaaaaatttatt

SEQ ID NO: 46619 - DNA, 325 bp, Homo sapiens
aaaatgacacttaggtgtaaatctagccacacatgcacagtacttgtattatgaaaattttaaaatgctcatgaaagaaatcaaagaagatcaaaataaatggagagacatatcatgattatacattgaaatactccacatcgtaaaaatttcaattcttccaaactattatgtaggttgtgtaacatatagaagttgcatacatataacatgcatattacatataagtatatatttgtgtttataatatattacagatgtttatatgagcctatttcccataagtccctttatagataataaaatatattacatacatatatat

SEQ ID NO: 46620 - DNA, 463 bp, Homo sapiens
ctttattagcagcatgagaagggactaatacaccatgtgaagataaaggcagaattggaattaagatgctgcaaggaaaacttggggatttaaaagctgaacaaatcatggaaatgtttctttcctagagcttatggtccctactgaccttggacttctagcctccagaattgtgagagaataaattcctgttgttttaagtccccctacccccactcctcaaaaacaataaatcaaggctttgactgacctggctggtgacctggtgctgtgctgtaggaagagacagaagattctcagctacaggagtagagccgaggtaggagtagggaggtagtatgaatagagaaatttagtggacgtgatttcaaagtcagtaggtaagaatgttttacttctatgtgactctcaggactataaagcaaattatttcagaatgtattactttaatgtgattctcaaa

SEQ ID NO: 46621 - DNA, 378 bp, Homo sapiens
ttgtattttacaatcgacgttggtgatagtaatgatccttcccaagaactagacaggtgccgggctcgccgaccactgcagcccttcaggacaggttctccctgctgctgcctctggacacagcgggacacttgggaaagtcccccttgacctccttggcaatgccagattctaaatccctccctcattatctgctgtgttgctcagagcctgctcgccctagactaacctgggacgcttagcaaagccagcaacaggtgagcatcagccgggactctggaaatcagaaccttcaaatcggcatttcttttttgagacggagtctcgctctgttgccaggctggagtgtagtggcgcgatcttggctcactgcaacct

SEQ ID NO: 46622 - DNA, 299 bp, Homo sapiens
gagttggctcattttacagatggggaagcacaccttgatcatggctctgtctttcagagactggaaagtcacaggtgcagaatgctctggacagactaaggcttagagcaaatttgctgagggtgacgtggcctgtaaggggaagggttgacactcgaacccaggcctttctgactgccgggtgagtgtgtttttctccacatcagtttttctgattattcaagatgtaggtttaattctgtcattgtcacagccctgactctgaggcaaatgtaaatggtgccccaggcctcagaccc

SEQ ID NO: 46623 - DNA, 423 bp, Homo sapiens
tcaacagaggagttggtgaaataaattattttgccttttggtcatgtctagaattcagatagtataatggtgtgttattttatgagtcctgatgatgtttaccaataaaaatcaatatccttttattgctaataagacatttggttattttccagatccccctaaggacaatggtggttcagaaatcctcaagtacttgctagagattactgatggaaattctgaaggtgaagtttttggcaattgttttattcaaatccaatagcaagctctgttttctaatatagtaaatgtctttatagtaatagtgagtaatcattaattctaaagatagaattattattacaataaacaaactttagtcacatattggcagtttttctatttcaaacacagcaccagagatcagagtctacttgaaac

SEQ ID NO: 46624 - DNA, 704 bp, Homo sapiens
ctgtcttacctccacataaatcagccttatttgtggaggtatgcgtctcctttttagaggcttttcaaagcatttacctgattttcaaataagtaataaacctcttggtagtgggcacttactttgtctctttacataaagtaaattataattacaacatagaaaactagcataaataagtttagcaacaaacccaatggatatagtaagcaaaacagcctaaccgatggaagtagaagggcgcaggcttaacagagtacctgagcaaccacaagcgtgtagcaccccgtgagcaacattcagtatgttttacagaggaaaaggagagtctgttaatctatcaaatctgttaggtaaagatctgttaagagagcttctgctgtaaattctggaataatacatcagacatagggtgctttaaagaggatataacacagttaagtagagtgcttcagtggagactcttgaatagtagagtgataagaaaaaatttttatttcataattcttccttaggaatggcttaaccagaatgactacatgtgtcccagtatattagaaagatataagaaaccaaatgcattatacttttgggtatattactcagataatttgttacaacatttacatactcaaataactaaaagccaagatcgcgccactgcattccagcctgggtaacagaatgaggctctgtctccaaaa

SEQ ID NO: 46625 - DNA, 932 bp, Homo sapiens
gagcctgagagactggaataaaggacagagatgggtttggggcacagagcaacccatgccactcctaccctgtgatgcagaaatattaagggggattcagccacctaatattttctggaagtggaaaaagacatatgtaactgtggtaaagactcatgggtcactttaggctatatgtgttttatgctgcagcactagaacataggagcagcttaaataatcagatttatcatctcacataaaatgtcagtccctaagtaggacagctccaggggaggggtggttggtttaactaagatatgtccccaggtcagaatcaggcaccttggttttttccctctttctatgctgccattctctccccatgaccacaagtacctttcttggctgcaagatgattgccatagctctaggcattgcatgctcatacaccaatcgacaaaggcaggagaagcatagtttcttgttttgtgcctttttaaaagtttaaaaagaaaaaaatccttccccacaagcatctcagctgacttccttttacaactgattatccagatctggatgacacatccactcctaaaccactatgtgaaaccaggaaagggaactcttttcctccaccccaatgattggctgagactagggatttggaggagccatgaatttggatacagaaaatttttctccctgaagccagggtcttgctctatcaaacaggctgaagtgcagtggcacaatcatggctcactggagcctcaaactcctgagctaaagcaatcctcccaacctcagcctcctgcctagctgggactatagatgggtgccactatgccaggctaattgtttttattttttgtagagatgggatcctgctatgttgcccatgctgggttttttggggttttttgtttttttgggttttttttttggttgtt

SEQ ID NO: 46626 - DNA, 411 bp, Homo sapiens
agatacatagatagatgcatacataattccaaggtctccggaagctttcttttctgcctccaagtcctttggatgtttggttagtggggtgagatagtgctgctgaagctgtgagggagctgataaaggaagaggcctcttctctttcctattcctttccactaaaactgagccttcttccccttctccttcgtatgcagttagcacagtggagtgtgtgatccttcctggctcttctgtacgttctataagattttatttcctgcatggttgaacaccaagcatgaagattattatttgtttatttgttattgattagttgacagccctacctgcatccagaaattttatactaaaaacataggtacaaaaagatcaaaacaatatataaaacaaaagcagatatcaggc

SEQ ID NO: 46627 - DNA, 3104 bp, Homo sapiens
  misc_feature (129)..(129): n is a, c, g, or t
  misc_feature (366)..(366): n is a, c, g, or t
  misc_feature (1906)..(1906): n is a, c, g, or t
atcgcttgaacccaggaggcggaggttgcagtgagccaagatcacgccactgcactccagcctggccgacagagtgagaacccgtctcaaaaataaattaaaaaataataaaaaataaaacaaagtagnccatagatctaaatgttagagctgaaactacaaaacacttgaagtaaatacaggagtaaatcttcatgacctgagttaagcaaagccttcttagatgcaagaccaaaagcacaagtagcaaaagaaaaaagtagacaaactggacttcatcggagattaagatttgtgcttcaaaggacaccatcaaggaagtaaaaagacaaaccacagaatggagaaaatatgctgctgggactngccacctcctgccgtgctggtgggggaagcgccatgctgtaggtggggtctggcctggtctctgcccagcaaactggctgtggcccgggcaatccctctcctcctgggtctgtttctggggctatggagttgagggtggagccagcagcaaggggacagggctcgctgggggacccgcctgcctgtgctgctgccaggagctctggaactcccaatacctggcagcttctttgcctctcagagttgcagcccttgggtgatgttgcagctcacatttccccatttctgattactgcttgccccacttcctcctgtgtcccctgcacccactggatgggacttggttagtcagctgcagcctgtctcctcacccagggggcgttgcccgaggtcggggcctgatctgcttcccctccacaggcaacccttccattctagttccttcccttcctcctccatgcaggcctcaggtgaacctgttcagccttgcccctccaggagctcagggtctgaaaaggaggtctacagactgtagagccagagagtgggcctggggccctaaagtgcgaggctttggcctggttgagggggtagggccttttggggcactctggttttgttggctccgttcctgaggtgacacccggatcaccccacgtgttaaaccccgagcgcgggctgccctgtgctggatattgcctacatccagcagccctctgagggatggtttctggcctgcctccgttgccagggtcctcactggtgtgaccaaccatctggcttttaacactaaaaagccccacatcctgaggaatcccaggacacagaaagtcctgggttttgtcagtgatgcagaaggttgggtggaaagtatgaaacccacacagagggatgacagcaccatttgtagcatcggatggaaatggcgtggatgatctgcctcgagtggtcactgtcgccatgttgcctgacgtggatgctggcatcaggacttgtgattcaccatggatcacatcactcaggctgcaactccgcacgctgcagtcatgcatgttagcagcacttgcctaggagtctgctgcagattcagtgttgggctttttgtctagacggtgctggtttcagtcttgacatcatgaatattgtgactgtatttcctaagagttcagatgatgaaaatgagaacggtgacaatgacagcaccagcgtgacccaggcatcactgggaaagaaggttaaatgaccatgttactttaatgacagatgcaaggacacacacaactggattagggaggaaagaacccaaacagaatgtactgcgcggtgtgcagaaaagaatgtgagaaatggcatatggagaaggggaggtggaggcacattggacattgagtctctcaagtctgaggcatatctttctaaatcaaggtttttttgacctccaaagagacagcagttctcagtcaaaaacagtggtcgcagaattagcttgggcgcactccttgaatggacgccattatcatcttgttcccttgattgcacngcaaaccaagaaggttacatttcctgattcggaggttacaaactaaaagtcctgtgtgtgaaccaaaggacgagggactttcagtaacagatgcattgcccctttacagtagtgctgaccctgtctgatccttccagcattcgtgcttccgagtgcgtcaagggctgcctgaagtcatggctacaggtttccgctagctcttaggtatgttgatttgaaaactggagtttcagatcgtcttctcgatttctgtgaagattttagtgaagccactgaagacgtaagagattgttgttctcttgtccaaatacaacctagactttgctcatttatctacatatttggcagacagtacacagttaatttgagcaaatttcatttagtccataagcttcttaccaatgaaaatgaaaacatcttacctgctaaatgttcacacctcgtacccgacactgtcacaaaggggtgtaatttgcttacctgtgataccagctttcataatgaaagttttgggtcacctttcggtttcctcaaaacatgccaaagcacttaatgagatctttgactttatagacaggagaatgcctcagacacgtttccacaagatgactatcattgctggccatagaaaagatgttaaaatgttggcttgccatgaaaactgctattttttaaagtgtgagacaagaaggatgtccttctctaatttggaaatgcattgagatgagaatggaaaaaggaattacaataaaatacaggccaggcacgttggcttacgcctgtaacccgagcactttgggaggccaaggtgggaggatcacttaaagccacaaattcaagaccaacctgggtaacaaagcaagacatcctcaccatctctgcaacaaaaaaataaaaataaaaaatacataggctgggcgcggtgactcacacctgtaatcccagcactttaggaggccgaggtgatcagatcacttggggtccgtcgggagttaaagaccagcctggcaaacatagtaaaacaccatatctactaaaaaatacaaacattagctaggtgtggtggtacatgtctgtagtcccagccactcgggaggctgaggcaggagaatcgcttgagcctgggaggtggaggttgcagtgagccgagatcacaccactgcactccagcctgggtgacagaatgagactccgtttc

SEQ ID NO: 46628 - DNA, 427 bp, Homo sapiens
ttgaatgtccatgaccaagaccatggtgttccacaactccaggggttgccattttctcacaggctatgcaaatgacatttcctgagttgcacagtgcatggccttcacaattctatggtctggccctacccacaatatgtcagacaaagtcctatgtgtgtatattcaatcttattctcaaagccactgttcaaagtaagggtgattaattttctttattagagaacagcaggctatgactctgacaggttaaatggcttgttgaagcctgcagactactctttgcaacctgccaaactttcattttgacatggaggactcctgttagcatttgttgtaggacaggtctatttgcaatgaactccttcagtttttgtttatctgggacaatccaaatttctctttcatttgaatgataattttgcta

SEQ ID NO: 46629 - DNA, 450 bp, Homo sapiens
agtcaaactctgaatctgcaccttttttctcacatgtcccaccagcagaaaaaaagctactaagttttattttataaacatttttatttggagaccatttgccttctttttggaaataccactcccatttcagtggttcagtggttcctactctgccctgacttctgtgtaacaggaaagaatccagtatcaattatttataatttagtttgaattaaatgttaagtacatggccattactttcctttgggactgctccattgaagttgttgttgttatttgtcttatgtaattaaggactctgctcttttaagagatttaggatgtcggccaagcatggtggctcacagctataatcccagcactttgggaggctgaggcaggcagatcacctgaggtcaggagttcaagaccagcctggacaacatggtgaaacccccgtctctacta

SEQ ID NO: 46630 - DNA, 306 bp, Homo sapiens
agagtatcccttgagcccaggaattcaagaccagcctaggcggcatagcaagacccagtatctattttattttattttgtatagagacagagcattgggtgagcaaacagtaagatttttagggtaagagaagctgttcggctgtgaggcaaaagcaggtggacaattcccttcagaaccttcattcttctggcaaagccaagttttggagcttgttacaaaacttaaaccccagcccagactgatcccttgtgacctcatatctgtcaggacactcatcatgtggcttcttggatcactgttggt

SEQ ID NO: 46631 - DNA, 729 bp, Homo sapiens
aataataactgcttactaaaactctagttacgccaaactttctttaaacatttttggtgagagtaatggtggagaaagaggcaaaatccatttaattcacctggtcacttatacacgcatttctttaaaatatctgattaggtatttatagtttgaaagagatgatgtttccttgactgagcatcttgagaaatcaagatttagttgacaattagacatgaggagaatagagagctagaagaccttgcataaactgattgaccaagagaatagatacactaatcatgtctacaggaacagaaaataaaagagacagagaagagataataaatctgatggtaaaaaaaaaaaaaggcaggaagattacgaatggcttctactctctgggtgtggtggcgcatgcctgtaatctcagcacttgagctggggaggtcaaggctgcagtgagcctaggtagtgccactgcactccagcctggacacaagagtgagagagaccctgtctccaaaaaaaaatgatttgatcatagcctcatatatgatttgactgcccccttgtggtaatttacatttgtcaatggtttagggagacttgcctgtataccgggatatacaaatttatgcaagcacgaagacagtttaatttccagttttaaacttttgacttgtgtaaaaccttatccccttcctaaaatattactcaaaatcattatctctgtttactttttta

SEQ ID NO: 46632 - DNA, 2360 bp, Homo sapiens
ggaagtgcctgcaaccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagcctgcatttgaccacatttagcctgcagtacacacctcctgtggtggcctgtgtctgcattcacctggcttgcaagtggtccaattgggagatcccagtctcaactgacgggaagcactggtgggagtatgttgacgccactgtgaccttggaacttttagatgaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttggggaaaaaaaaattttttttaaaattttttccccaagggacgggggaaaattttatttttaaaatttttt

SEQ ID NO: 46633 - DNA, 560 bp, Homo sapiens
ggaagtgcctgcaaccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggtaggagattaattacacatctgtttttcttaatttttttcctttctttttttttccctactcccaagcatgcctggatctttatgtatttcaatgcaacttaattttataacttcgatttattgaagtttagattggtgttgt

SEQ ID NO: 46634 - DNA, 314 bp, Homo sapiens
gtatccttgtggcctaggccttcggccttggagttggtcccgccatgctctggcgtccgggtctcaggctctgtgggggggacgaaagtggggaagaaggtgggcagaagctggatgtctagttgggagagcccacgatggggcgggctgaaactcagttagcgctagggaagcgaggcagagttgatttcccgctcgctcacccgtgccgccagccttgctgggaattcgtatccttcccggctttgtgttttaaccagcccttccaactctgtcttcattgtgttctgatctgctctggtgacgttaagatt

SEQ ID NO: 46635 - DNA, 493 bp, Homo sapiens
caactgacgggaagcactggtgggagtatgttgacgccactgtgaccttggaacttttagatggtaagttttagagtaagggaccttgaaaagcacttgctgttgatctgtcacatagctggccaaaggtgacttgattcagatgaaaatagttagttagtagttcaggttattcttgtttcattacttctgtttctctcagtctttcttgaatgttctgttttacttgtagaactgacacatgagtttctacagattttggagaaaactcccaacaggctcaaacgcatttggaattggagggtaagaatcattactgtcagcttgtggaacaaaatcaatttcttttgactgcaccagtgaatataccagtattgaatatgtaccctaggtttggaattgccctttttatagttacacagtaatcatgacttctacttcataccttggatactgttgtaaaagtcagtgtctctatgggatagcaggattt

SEQ ID NO: 46636 - DNA, 2488 bp, Homo sapiens
ggaagtgcctgcaaccttcgccgctgccttctggttgaagcactatggagggagagaggaagaacaacaacaaacggtggtatttcactcgagaacagctggaaaatagcccatcccgtcgttttggcgtggacccagataaagaactttcttatcgccagcaggcggccaatctgcttcaggacatggggcagcgtcttaacgtctcacaattgactatcaacactgctatagtatacatgcatcgattctacatgattcagtccttcacacagttccctggaaattctgtggctccagcagccttgtttctagcagctaaagtggaggagcagcccaaaaaattggaacatgtcatcaaggtagcacatacttgtctccatcctcaggaatcccttcctgatactagaagtgaggcttatttgcaacaagttcaagatctggtcattttagaaagcataattttgcagactttaggctttgaactaacaattgatcacccacatactcatgtagtaaagtgcactcaacttgttcgagcaagcaaggacttagcacagacttcttacttcatggcaaccaacagcctgcatttgaccacatttagcctgcagtacacacctcctgtggtggcctgtgtctgcattcacctggcttgcaagtggtccaattgggagatcccagtctcaactgacgggaagcactggtgggagtatgttgacgccactgtgaccttggaacttttagatgaactgacacatgagtttctacagattttggagaaaactcccaacaggctcaaacgcatttggaattggagggcatgcgaggctgccaagaaaacaaaagcagatgaccgaggaacagatgaaaagacttcagagcagacaatcctcaatatgatttcccagagctcttcagacacaaccattgcaggtttaatgagcatgtcaacttctaccacaagtgcagtgccttccctgccagtctccgaagagtcatccagcaacttaaccagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccagaggagataaaaatgcgcataaaagtccatgctgcagctgataagcacaattctgtagaggacagtgttacaaagagccgagagcacaaagaaaagcacaagactcacccatctaatcatcatcatcatcataatcaccactcacacaagcactctcattcccaacttccagttggtactgggaacaaacgtcctggtgatccaaaacatagtagccagacaagcaacttagcacataaaacctatagcttgtctagttctttttcctcttccagttctactcgtaaaaggggaccctctgaagagactggaggggctgtgtttgatcatccagccaagattgccaagagtactaaatcctcttccctaaatttctccttcccttcacttcctacaatgggtcagatgcctgggcatagctcagacacaagtggcctttccttttcacagcccagctgtaaaactcgtgtccctcattcgaaactggataaagggcccactggggccaatggtcacaacacgacccagacaatagactatcaagacactgtgaatatgcttcactccctgctcagtgcccagggtgttcagcccactcagcccactgcatttgaatttgttcgtccttatagtgactatctgaatcctcggtctggtggaatctcctcgagatctggcaatacagacaaaccccggccaccacctctgccatcagaacctcctccaccacttccaccccttcctaagtaaaaaaagaaaaagaagaggagaaaaaaacttctttaaaaaaacacataatttttcttttttttttttggactaagaaaattacttatgaaatatgtcatccttggactagggaataaattgatattgagacatagttaggagggtggtagaaggccttggctatatatctgctgtctcatgcatttaactattttcttacagtttttactggtattagagaggtgttgaagctgtgaaggattaaggacacattctgaattctt

SEQ ID NO: 46637 - DNA, 462 bp, Homo sapiens
cagtgtggagatgttgccgggcaagcgttggctgtcctcccaaccttctttcaaactagaacctactcagggtcatcggactagtgagaatttagcacttacaggagttgatcattccttaccacaggatggttcaaatgcatttatttcccagaagcagaatagtaagagtgtgccatcagctaaagtgtcactgaaagaataccgcgcgaagcatgcagaagaattggctgcccagaagaggcaactggagaacatggaagccaatgtgaagtcacaatatgcatatgctgcccagaatctcctttctcatcatgatagccattcttcagtcattctaaaaatgcccatagagggttcagaaaaccccgagcggccttttctggaaaaggctgacaaaacagctctcaaaatgagaatcccagtggcaggtggagataaagctgcgtcttcaaaaccaga

SEQ ID NO: 46638 - DNA, 972 bp, Homo sapiens
gctgattacaaataaccagtttgcttatttatcatgaattgtggaagacacaaatgtcagtacgtattgttcattcaatgtaacctgtgccagttggcggaagtctcagaggattgctttgtcccttcctctgtcagaacagtgactctgtgttaagccacttccttctgtgcatgagtggagagatttggcctcaccgttatgagcggtctcacaggcatgaacgtttataatacacatcaaagatctctcttgaatgttgtctggaaaattgtttttgtttgttttttgagtaatagaaggctaatattagtgcttgtttgagtactaaccataataaaggcatcaaggcacaacgcagatatgtattagcaacttaaaagagtcaaatttgagacactgtcctttttaaatctagaaaacaaatgtcttcctccctattttctcttagccccagtttaattaaaaattaagccacaataaaatatggaataactcataaatagttaatattaaactaccagctactgagaaatcagctgctaaaacctatttctttatgttactaaggtcacaccatgcaaagaccagcattgctggtactccttgaaggagtcatgtccctggtaactgaattctatgaattgccactgttttcctcattgtgttaggatcattaggaatttaagttgttctgttcactctgctttaaaaaaattcccttatacttttgagtatggtttaattctgtgttcctaaggcagtcaaaacttccttctcagaagtaaaacatttttctagtgttgtgcgttcccatttggtctaacctaatatttctttagctgatactctcccaagatagttgccaaattactaccaatagtccttccatacctgctttggtgccttcttttgataaccaaataaaccacagactactatgtctaatttttacatattcagagtgtcttt

SEQ ID NO: 46639 - DNA, 245 bp, Homo sapiens
ctccgtctcaaaaaaaaaaaaaaaatggatctttattaagactactaaaattaatacacccttggccatagtcaagaaaaagaggcagtggatccacatgttcagtattagaaataaaagaggaaagtctgtacaaatcccacagatatttaaaagatcataaaagaatattatgaactttatgccaataaatatgaaaatttagatagacaaactcttaacaaaatacaacctgtgaagacata

SEQ ID NO: 46640 - DNA, 273 bp, Homo sapiens
agaccagggccccttgaaggtgatgaggcaggggcaggcacagccggccataggagagggctcagcctgtgcctgcccctgccccattatcttcaaggggccctgatctgcctgatccacatgcaggggcttggggggaagatgacaagcatggaggaatccacctctgggctagtcccttccaggaggccccttatagctagcctgatccttcccctagccactgaccccagaccctcctccagaagctgtgagtgtagtgtggaagacata

SEQ ID NO: 46641 - DNA, 562 bp, Homo sapiens
tgaaggattgatacttgttctctgaagatgggcaatgtggcggcattgtgaggagctgtgctctggagccaccttgcctaggtttgaatcccggctttgccacttgctagctgtgtaatgttgggcaagtgccttgggttctttaaatgcaaagtggggataataatagtacctacaagatgggtttttataagaagtaaatgaattggcatttagaaagttagaagagtactcagtgcataattatgatccaaaaagtattaaataaaaatgaagttctctttcctaatggcacaagtggtaacccctaattctctagcctgcaggcctgaaggctcaccctctacttggtttaatattgatctggaaggaggcagtttcagatagaatctgtatgtggattttgctgtattattgttggagtaaagttgacaaaatctggattttggctttcagtatgggtacaacaatggcaaattatccaaaagagctctatgttgaacatgtctttttatctctaactttttactctgaaaatattccaatttatcaaaaaaaaaaa

SEQ ID NO: 46642 - DNA, 417 bp, Homo sapiens
tggtgtcaggcagaccctggaggtaggtctgctcttcctggtagcaaagcaatctatggtcacaatgatttgtttcttaaagggccctaaagaaacactagttctcatcaaagtttagcatcctgtgtctttgaccatcttgttcaatgagaaagagtttaggcagcatctgctacatgttcaacattctagttattactagagaggatgaaaaatattacacatgggcctttcccacaaggtattaatagtatagccagacaggaaagaattgccttgatgaggtgagaccatacagaattgagttttaattgtgtgctatagactaagttcagaggagaaaaagcaatcaaaataattactcattcatttaataaccatccgttaagtatttaccaaacacaggacaatgaacta

SEQ ID NO: 46643 - DNA, 3068 bp, Homo sapiens
aaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaatatgaggtgttgctgtgttgcccagactggtctcaaactcctggcctcaagtcatcctcctgccttggcatcccaaaatgctggaattagaggcgtgagctactgtgcctggccatttttataagcttttaagctgaaatgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacctgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgca

SEQ ID NO: 46644 - DNA, 3452 bp, Homo sapiens
aaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaatatgaggtgttgctgtgttgcccagactggtctcaaactcctggcctcaagtcatcctcctgccttggcatcccaaaatgctggaattagaggcgtgagctactgtgcctggccatttttataagcttttaagctgaaatgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacctgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgcaaaaaaaaaaaaaaaaaattccaaaaaaaaaaaaaaaaaaaagaaagaaaaagaggaaaaaggaacagggagcaaaaaaaaaataaccacggggtgacgcgaatgcacactcgaacgcgacacgcacacgcagccacacgactagtgagcggggacagaagtaatgacgctaagatcaaacgcagccagcacctaactgagggcacgacacacgagagcaggaaagacaaagcgtgtaggataagaaagcaacaaacgcacgccgaccactcaggcgaggaagtaaaaaaagaggagctcggacgaataccacggaggaacgaagcttactaactcgagccggggttcatgcggcacgcaccacgaagcccgaggaacgacaacg

SEQ ID NO: 46645 - DNA, 1640 bp, Homo sapiens
caaccatcctctctctgcttggaatggggaaaaaaaaaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacctgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgca

SEQ ID NO: 46646 - DNA, 315 bp, Homo sapiens
gtgggataattcagagcatgccaagatattttacttgtgacagcttagcttttaattttcttttaccaagcttcttcattcacatatgtttctaggatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtt

SEQ ID NO: 46647 - DNA, 896 bp, Homo sapiens
gacagcttgcatgtcagcctgccagcatctgtcaacatccttaatgcagatgctactggacagtgagttaaaacaaataagcatgggagctgttcagcagtttaacttagatgtcatacagtgtgaatgtaagtactatattggtttattcttatgtattactaggaatctatgcttaaattatatgaaaaaatgtatttagcaggatagttcagaaaggagggagaaggcctggttcagctaaacttttagcagccttaggagtagggctaacttcctgaaacaggaagataaaaatatctcagcttcacatttagggcctctagagagaggcactgaagtggcattccagattggtatatttaaaaacatgattcattttccccattattccttgtctggtcattcttgcctttttctaggactctcctaatgtttgtcataaatgaatgaaatgattctgtcattcttacttgccctgtaagtaactttttagatacttgctagaagaataagctcaggaccttgcattccaaatgaaatttctgaatttttgtttctcctttccttagatttcacaaggctttagtattgccattgtttttcactttatttttttttaggtaacaaggctagcagattccataatctaatgttgatgttagtcaatcagcttcaaaactggatatgctatttggtcattagccttgttacatgtgcttttggatatgggttttatcaaccctcaaattataattctttaagtacaagatatgagtatatgtgagcaattttcaagcagtgctttcaaataagtggtacactgattaaacaatgaaaatccctggttgacaattctatcaggcaccacagttgataaattgaaaatcagtggg

SEQ ID NO: 46648 - DNA, 2930 bp, Homo sapiens
aaacattctgacaaaataggtgaaacagcaatgaaacaggcacagcatcagaaaaccttcagtgtttctctgcagaaacaaaataaaatgaaatttgggaaaaatatgtatataaatcgtgatagaattccagaggaaaggaatgaaactgtattgaaacattcacttgaagaagaggatgagaatgaagaagagatcttaactgttcaggatcttgttgatttttcccctgtttatcgatgtttgcacatttattctgttttgggtgacgaggaaacatttgaaaactattatcgaaaacaaagaaagaaacaagcaagactggtattgcaaccccagtcgaatatgcatgaaacagttgatggctatagaagatatttcactcaaattgtagggttctttgtggtagaagatcacattttacatgtgacccaaggattagtaaccagggcatacactgatgaactttggaacatggccctctcaaagataattgctgtccttagagctcattcatcctattgcactgatcctgatcttgttctggagctgaagaatcttactgtaatatttgcagatactttacagggttatggttttccagtgaaccgactttttgaccttttatttgaaataagagaccaatacaatgaaacactgcttaagaaatgggctggagttttcagggacatttttgaagaagataattacagccccatccctgttgtcaatgaagaagaatataaaattgtcatcagcaaatttccctttcaagatccagaccttgaaaagcagtctttcccaaagaaattccccatgtctcagtcagtgcctcatatttacattcaagttaaagaatttatttatgccagccttaaattttcagagtcactacaccggagctcaacagaaatagacgatatgcttagaaaatcaacaaatctgctgctgaccagaactttgagtagctgtttactgaaccttattagaaaacctcatataggtttgacagagctggtacaaatcatcataaacacaacacacctggagcaagcttgtaaatatcttgaggactttataactaacattacaaatatttcccaagaaactgttcatactacaagactttatggactttctactttcaaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacctgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgca

SEQ ID NO: 46649 - DNA, 1642 bp, Homo sapiens
  misc_feature (9)..(9): n is a, c, g, or t
gctggtccngtccggaagtatgggatcatgcagccatgtcggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtagacctcacatggcttgcactcagtgacaccaaatccatgattcaatgttgatcttgagcaagtattggtcatgatacagtaatttgtttacagaatccaaaaatacaatagagaagatacatgagggcttaaacaagaaatagtaataaatatcatttgtatggatttttaaataatcgaatactattttatatatggaaaaaaatgaccattttttcacttttaggggaaaatgcaaaagtgtaatacataaattgtcacaaattatacctgaaattgattacaaatacatttgaaaaacatatgcctctactcataagtatttttttctatttagacttgaatgataatctgttttttgatcagtatatggctttggaattcaatcatgtctgatatggtagtatttcactaccattttctgacttttagcttttattttcacctcaatgtgatttaagcagaccaaaatttctaattctgctaattctgaaggggaaatagacaaatcttaaaagctgcctgaaatcaaacttgatttaactcagtaagaatgtgaattatttgttctacttgggtggtttaatttaatcgttctgaatatgaacaaaaggttttggattttctaaagatgcagtgttgtttctgttcatcagggttaatatttctaactatattgcttgtaggtgaccccattctggatttgtttggtttggtttggttccagttaaaagagaggacaggaactaaatggggctaaccacttcaggtgcagcttgtgcgagggtagatggttcctgcacacagaagttaccacaggggtcaggttactttcttcaaatagcagatttcagtactttatcctcattgtggaaacaagccaaaccaaatgaactctggaaaacctaaaacaaatgtacattttcctttgtgtatgtttccgtggtccaaatggcaatataaatccagtctttattctccctttgttgtatttatgctgaatcttccctttgccttttcaggatttaggcctgtaagaaactatgcctgattctgtaaaataagtgtaaagaattatatgtacatctctggattttgtgatgaaatattaaaaatattgagcaagttgttgaaaatgca

SEQ ID NO: 46650 - DNA, 500 bp, Homo sapiens
gtgatacggatgctcttctacacagctcctgaacctctttgtatgtttccatttcaatacgtgagcattttcctttgaaggctctcttcagagcttccatctttctcttcatttctgatttgtcttcatttcagaatgattcctaattctctagagctaaaacaccctgctttccagggctccccatcatgtcatgatttcatattacttgaaagtaggcatggtgctcagagagctggatcgaatgcgtctgccctgactccctgtggactgggtttggggggaagggagtgtgtttctgtggggacgagggtatatagaggacttgtccataaagagggatcaagtggcccaccgtgtggtggctggcaagaaatgggatgtcttaaaggagtgtaaaggcatgcattagtgagaaggaaggacgagaactcatgagccagtcttgaacgtggcagatggttgaaagctggtgtgcttggctgaaggaaaacatgcca

SEQ ID NO: 46651 - DNA, 425 bp, Homo sapiens
tgaggtgacttccagggtacttaaaaacccagcattctttttcttctccttaatttttatcttttccccttttgggagccatccattagagactgggacattccgaagtgactgcatatatgggggatattggaaggtgactatgtatgcccagggaaaggcacaggctcagaaagacctgagaagaccttaagtttaccttaaggtcaggttagcctaaccttaagctcaggctaaccctcagcactgagacagcctacaacaattaaaaaaacaaaaacagtaagcaacaacaacaacaaaaaaacaaaaccaaaaacaaaagcccagtaaaccccagggaagggagagaacctaatttccagtgttatcaaatcattagcttcaaatgtccatttttaacaaaaaaaatcaagagacataca

SEQ ID NO: 46652 - DNA, 623 bp, Homo sapiens
gattaggtgagttagtaaccacaggttcctagaatatggtgggctctcacgtatttagaaagaagaggcacatcttgataacatgccgagaactgaggcaactgatgtctttaggctcttatagtcccagcatgtttttaagagctactgaatttgaagagaccatatcagtttcatctgctcaaattagatgaatttgcagttcatatcccaaggtttgttgttcttgttttttataggacgtgcaatccctggtataaaataagttgaaatccagttgactcatcattctatgaaggtgttctgagcaccatgctggtcattccacagattggcaaatgtggcttctgtgaactcatctcccctggaacttagcagcacaagcgatatttcttttctgatttgtgcatgcaatctttcccctacttttcacggttgcacttctttgtttacagaagagattctggtcatttccacccctgccactccactctcccagcctctctcattggttcacagagtatctagaaggcctcaaaataaaatcatctctagagtaaaacataaataccatcctaacctgttctgcaggaggtcaggggccttcttgttagagagcagtg

SEQ ID NO: 46653 - DNA, 404 bp, Homo sapiens
atttgattgaagaacaaccaaaaaatgctttggttatgttagctatgtagagctgtgagccacagagcccagctgcctcttccttttggatgtagattatgtgtaggttatatttataaaaaatctggctgggtgtggtggcttacacctatagtcccaggtaagtggatccatgtgagtagaggctgaggtgagtggattgcttgagtttgagaccagcctgggcaatatggcaaaaccccattctacaaaaaagtacaaaaattagccaggcatggtggtgtgcacctgtagtcccagctacttgggaggttgaggcaggaagattgcttgatcctgggaggtcgagggtgcagtaagctgtgttgtgccatggcactccagcctgagtgacaaagcaagac

SEQ ID NO: 46654 - DNA, 423 bp, Homo sapiens
tgacagcaagcagcacaaggtcattaagtagtactggctgggaaaatgccaggctttgcattgtattgtggtaaaccaaattcctgaagcccaaagccagagagccgcagccctaagctccatatgaatgttgatcctaggaaaaatccctggtggtttgcctgaggaatcattggcaccttcaagatgtgaaattgatgccaatgtaggatgtaaaatgcaaaagccaggcaggaaaaaagattcagatcatgtggagtaataaaaaacatccaagttcctaccctgtgccagaggaacttaatttattggcttgccccgttctcagtatggcatcacaatagctgtacctaatttgtattgtgcctttcatgttacagaatatttcacatgcacaaacatgtttagtgaataattaggatg

SEQ ID NO: 46655 - DNA, 441 bp, Homo sapiens
tagaaacagagaggttaggaagagtgattccaaagttaaatagtaccacagaagcatggagcagaggatgtaagctgcataaatctgaagaataataaaaactcaaataagatctgtgaatttgtcttttagaacatcaatgttgatctttgaaaattccatttcggtagattggtggaagcagaatttcaatttctgagaactaggctaagattgtgtagacgggaagtaaaggtagcaagtattaagcccttggtcaagaagttatgtgtttgtttgtttgtttgacagagtctcactctgtcacccaggctggagtgcagtggcgctatcttgggtcactgcatcctctgctgcccaggagcgattctcctgcctcagcctcccgagtggctggaattacaggctcctgtcaccacgcttggccaattttttttttgt

SEQ ID NO: 46656 - DNA, 701 bp, Homo sapiens
tggccgccactcacttaggctcatgcagcacagactccagttagggtttgcactggcttccttgctgcttgtgcatgaatcttcagctgccctcccatgtcctgtctctaataattgctgaaaactcaaagaggtagataaataagcctccttgggatcaatagcagaaggaactccaaggctgatggtaaagcttcgtaaggatgatgccgaaagggaactggggtctccatggtgataagaggctggggaccaatgagagctgaaggcggagcaggacttgcggggaagactcatgggagttgggagtcatttaactatttgtttgcttcttgaaaatttagacaccagctgtaactacattgcacaggatgtattgatattatcattcttgctgacatattctggaagctttcagccccaccaacactgccccacccaggacttctgcagctgagagttcctgtgtcagtagggtctgatatttgtacataggttatacatatatgtgtacatatgtgcctcaatgaacattgcctgtccacctgatcatgggtgtacatagacttcatagagctccacagtcttttgtaaatattgacacaagtaaataagtatataaatatatattactggggatttattttaacatcattctgtgtgatatgaaaaaaataaaatttttgacagacaaaaaaagt

SEQ ID NO: 46657 - DNA, 1010 bp, Homo sapiens
catgtccattttcacattcttattggaaaataaaattgtactaatgtgaaaatatttggagataattgaaaatacttgtttgctatgaaaattactattagaaagaaattgagaaatatgagtatgattttatctgtagtacattgcccacaaaaatccatggatattattgaacattcgattgaactctaatattctacaattatagtttcaaaaactaaaaaatttgtgattactaaagtgaatagctctcattgacaacctgcagttaatagaaagaacaaccttgatcaaataactctcctattaagatattgtagtatagattgcttagagacatacttgcaacttatttttactaaaaattctgatacttaataaagaaaatcaaagaatatcagacgtaaaatgggctctgcagttcatttagaccagagtttctctaaagtgagttctttataaagaaattaaaaatggaaatttaataaagagcttaaaattcgaattatattgattttgtaacattttgaatttattttataaatttgttttgagtttttaattatacaaaaatcataagcataagattgtaccgttttaagtttgtatatatttaagtatctttgtatcaaaaattattttgattatgttataaataataaaaagccaatgctgagggtcctccatgacttttgtcctttaaaaggactatgcatattactcaagtttaagaaacactaatctaaaaaatttctagtcaaacataggaattctttaatgttcttagcagtaaatgctcatatctcttaacaaattcttccacttattaggtttgttaacaattaaaattcatttattaaaagtgttacttttatggcatatgcctgtaatcccagctactcgggagactgaggcaggagaatcgcttgaacccagaaggcggaggttgcagtgagccaagatcgcgccactgcactccagcctaggcaacagagtgagactccatctca

SEQ ID NO: 46658 - DNA, 422 bp, Homo sapiens
  misc_feature (319)..(319): n is a, c, g, or t
gtatgcaaagtgctcatcatagtgcctggcatgaggaaaatattcagtaaatacctttgctctcacgattttagtctgcctgatgtgttttgtatgtcagcactctgtattttccttaatagctctaggctcataaattttgtcacctctctgaaacttaggccctggaaattggaagcaaatagtttgaaattttaacatctagttaatatttctcattggtgtacactcatttattcaatagttattaaaattctgatttgcctaattacaaaagaagtaattttcaatacatcaagattctttaggccaggcatgngtgtcacgcctgtaatcccagcactttgggaggctgaggtgggcagattgcttgaccctaagagttcaagaccagcctgggcaacatagtgagaccccatctc

SEQ ID NO: 46659 - DNA, 514 bp, Homo sapiens
ataaagtatgatttgttactggcgtaacaaagccatacataggctgggcattgtggctcatgcctgcaatcccagcacttggagtggttgaggcaggaggatctcttgaggcctggattttattttattttattttttttgagaaggagtcttgctctgtcccccaggctggagtgcggtggtgtaatctcggctcactgcaacctctgcctcccgggttcaagtgattctcctgcctcagcctcctgagaagctgggattgcatgtgtgtaccaccacgcctggctaatttttgattttttagtagagaagatgtttttccctgttggccagctggtctcgaactcctgacctcaagtgatctgcccgccttggcctcccaaagtgctgggattacagatgtgagcccccgcacccggaggcctggaatttgagaccagcctgggcaacatagcaagaccatgcctgtactaaaattttaaaaaattagccaggcatagtggcacgtgcctgt

SEQ ID NO: 46660 - DNA, 787 bp, Homo sapiens
gggtcactgcaaccttgacatcccgtgctcaagctgtcttcccacctcaccctcctgagtagctggtactataggaatgtgccaccgcatcagctaattttttattttttgtagagacggactgtcactgtcttgccctggactctcaaaatcctaggctcaaatgatcctcctgccgtggcctcccaaagtgctggaattacaggcatgaagcattgcacccaactggggttagcattttgctaacttgtatttaagctggcagaattgtagtgcaatcccgactggtgccgtcaagcttattttaccactttcctttttttatttttctattttaaattataagtggggctgagccaagtagactatatttgtacttccccatcttgtgtgtatgttgacactatttgtgtgttgacagccgttcacaaggttgtattttcttcagtttatccaacataatgttctttgataatgtgtttcatgtctcaatttttgttgtcaggaagttattctctaatgaccaatctaaattctttcctttcttctttcacccactttctttttatatgtatatatttaaaatatattttagtgaaacactttctcatcatctttagataaaaaaaaaatccattttttaatctgaagctccttgggcattaggagttaattgctttctgctccacagatttcagatgccactgcactaattccccagtgctcttgaggcagagcttagacatgtcctcctcagttggaaatccttgtggcaacttcaggggct

SEQ ID NO: 46661 - DNA, 742 bp, Homo sapiens
gtgcagaagcctgataaacactacctcagccgggtaatcaaggttaatacaaaagtgttaagtcacatggatgctatgtgactttgtgtgccatgatgaaaatggctttgtacctctgtgttcttccctccaaatcccataaccccaggctaatcatgagaaacacatcaggtaaatcccaactgagggacattctaccaagtacctgaccaaccctcatcaaaactgttaaggtcatcaaaaacggggacattctaagaaactatcacagccaagaggagccaaaatgggaaagatatgttaaagtcccaccccccggtaccttcgaatgtgaacttatttggaaatgggataattgcagctgtaattagttaagaaaaggtcatactagagtacagcgggcccttaattaatcctataggacgggcatccttataagaagagtaggccaggcacggtggctcatgcctataatcccagcactttgggagaccaaggcaggcagatcacttgaggtcaggagttcaagaccagcctggccaacctgtgaaaccccatgcatactaaaaatacaaaaattagccaggcatggtcgtgggtgcctgtaatcccagctacctgggaggctgaggcagaagaatcacttgaacccgggaggcggaggttgcagtgagctgagatcacgccactgcactccagcctgagcaacagagtgagactccttctccacaaaaagaaaaaa

SEQ ID NO: 46662 - DNA, 435 bp, Homo sapiens
gcactttaattgcgggccctcatttcctcttgactattttcaaaaattcttctgagttgtggcatttgcattttccttgttctttgttttcttttttgagaaatgtacatatagcaccacacaattctatttcccaagaaatgctaaagcacagaaaggaatattctattccaatttgtggaagttatttaaaggatccctttgttgttttctctttctaaagtccaagagaacaatgctttgcatatgcttaaacttcaagattgcaaatcaaaaagtgtgaaattcatcttggcacctaggtaaaattggtgtgagctaatgcagtcttttctgtgtcatttttcaagactggtgtttatcagtggtcagttttctctaaatccacaagaagtaagagaaataatactgatgaattaaatttcttataaggta

SEQ ID NO: 46663 - DNA, 408 bp, Homo sapiens
ggaagggatcttgtctgttttgtttaatgatatatccaaagtgctgagatactctggcctggtacattagatacagcagatactttacctggcatctaggggattctcaatagatatttatggagtggtgaatgactaacttgttcatattttatcctccacagaacctgactcagaatcttgcgcatactaagtcttaattatcagtccatttatttatttttttttaaatttttatttggatttttaaaagtgagtcaactcattagagtttcaatgttccaattcaaatatttaaagaaatctcaatagttaggaagaatgaatgagacctattatttaatagcacaacagggtaactatagtcaataataattgtacatttaaaaataactaaaagagtataac

SEQ ID NO: 46664 - DNA, 174 bp, Homo sapiens
ctccacatcagcacagaatcttcaaacagatgctcaccaattcgtgaacctggagcagtggtgctggaaagctgtctacatacacataggcattcacaagtgaaggccctgcttttggactgaagatgggaaaacgagagatgcttcaacagataactcaggttttcatgggtt

SEQ ID NO: 46665 - DNA, 359 bp, Homo sapiens
gtctgatgcctctctgggacccaggcatcaaatttgtccctaaattggaaccaggatcaggaaaagccttctagtccattaagcgattctgtgatatctttgcacaagcctctggcctgggctggaggggccaattatcaggaatgagttgttcaggttccagctgggtggggtggctcacacctgtaatcccagcactttgggaggccaaggccagtggatcacttgaggccagtagttttgagaccagccttgccaatatggcaaaaccctgtttctactgaaaatacaagaatgaaccaggcctggtggcacatgcctataatcccagctactcaggagctgggacaggagaatcg

SEQ ID NO: 46666 - DNA, 1300 bp, Homo sapiens
gtgccttgtactcagtagtgctaaattgctatcaactagtgctaaatgtactactaattcatctgtgtgtccacttcccttcttagattgtgagccccttgaggacagagatgggtttactcatatttataaattcattggcatgataaatatttgctgaaagaataaaattgtattcttatgttttaagcagggtcccctccacctctgagtggaagatggtctgggagcaaaggtgacaggtcttctaaaaaatctggccacattctcaacccaccacacccccgcttttttaaacagctatttaattgccattgtaatcctaaggattggatcaatttttcacttccctttttcacacttttttccttttactaagaaaataaagtaataaagtgactgccaaatggagaaaactgtccactaaatatgaattaataagtgctattatcagaaattgtgtaaaagcaacataatggcactataaaaaggtattatcttagaatcaaaaaccttgggtttatattatagccctgctactttctagtcatatgacagtgatcaagctatattacctctttggcttgacaaaataggggtcatctctatttctggcttgttatgattgatgtgaaatattcatacaaactaccactgtgcctggtaagtagaagacactcaaatatgtcttggagttacagttaatactgtatcgtttaaatttgagaaaaaccaactttaaaaaatcacatagatacagttgtttactgctagaaattttatttaaattagttgatactcttggttaggtaatgaaaaacaatggttttatctccattatgctgtgatagggaagagtaacacagttcaaatggcaaaggcatacctgacaattaaaatgcatagttaaaggctaatacttcctgaacacaagaagacaagtctctacttgatactactctccacagttaaatcattgatactttgtgccatacagtgaaaacagaaccatctaggtgttcacggattgtatttttccttatgaaaggtagaaggttagagaaaattattcccaatacaattaatacaaataaaattggttattaggtgccttttaattaggcagtaagggcatatgaagcttcattacctatgagaattttgtcaaaattatttcccagttaccatgttttaaaacagcctctcagaattccccacttctaatttctcctttctattctaccaattttactccatacctttttgctaaataaacattttcttccaactctgagtttgg

SEQ ID NO: 46667 - DNA, 440 bp, Homo sapiens
ggggtctttcattaattttgaaaatttttcaactactatatttttcagtattagttctgactcttttacctttctccttcaagctcacaattatataagtgttagatctttttcactgttttatatgtcacttacgttttagttctttcttcaactgtcatatctgctgttagactaattactacattcttaactttcattattgcatttcagttctagaattcctttttttttattttttcagatagagtcttgctctgtcacccatgctggagtgcagtggcatgatctcagctcactgcaacctttgactcccggattcaagtgattctcctgtctcagcctcctgagtagctgagattacaggtgcccaccaccaagcccagctaatttttatatttttagtagagatggggtttcctcatgttggccaggctggt

SEQ ID NO: 46668 - DNA, 226 bp, Homo sapiens
agttgtgtaccaaagacaattgtcactgtttcctcatcagtaaaacagagatactatcatactcaggatgttaaaatgataggaacactatacacacacacacccccatgcttatagtggatagatgcataacgccagtccctttgttttcattagaaacaaatgatgtgtttcttgatcctttctctcctctccaaaatgtcaacgcagtcatattattaagtca

SEQ ID NO: 46669 - DNA, 2541 bp, Homo sapiens
tctattttttggctattataaacaatgctgccgtgaacatttgtgtccaactttttgtgtggacacgttttcatttctcttggatacacactagcagtggaattgctgggtcatacagtaactctatgttactttttgaagaaatgccagacagttttccaaagtggctgcaccattttacattcccaccagcatatatgagggttctagtttctccacatcatctctaatacttgttgttgtttatctttttgattatagccatcctagtaagtttgaagaggtatctcactgtggttttgatttgcaatttcctaaccatttgatgacaaatgatgttaagcatcttttcatgcacatattttctttggaggtttgcctattcaggtcttttgcccattttaaaattgggtttatctttttttttttttgagatggagtctcgctctgtcacccaagcaggagtgcaatggtgcaatctcggctcactgcaacctccgcctcccaggttcaagtgattctcctgccccagcctcctgagtagctggattacaggtgcccaccactacactggctaatttttgtatttttagtagagacgggtcttaccatgttggccaggctggtcttgaactcctgacctcaggtgatccacccaccttggcctttccaaagtgttgggattacaggcatgagccactgcacccggctgggtttatgtttttatattgagttgtaggagtactttattcattttagctagaagtactttattcattttagcttatcagctacatgatttgcaaaaattttctctcattctgtggattgtcttctcactttgttgatggtatcctttgaaccacaaaagttttaaattttgatgatgtccagttagtctatgttttattttgttgtttgtgcttttggtgtcatatctaagaaatcgttgcctcatccaaggtcatgaagatttacctctatattttcttctaaagattttatggttttagctcttacatttaggtctttggtccattttgatttaatttttatataaggtgtgaggtaagggtccagcttcattcttttgcacgtggatattgagttgtgccggcactatttgttaaggctgttttcctctgtttaatcatcttaaccctttttggaaattaattgaccataaatgtgagtgcttatttctggactctcatttctataccattgaactataatatatatctgcccttacgccagtaccacactaattactatagcttcatagtatttgaaatcaggaaatacaagttctccaacttttgttctttttcaatattgttttggttattgcaagtctcttgaatttccatataaattttacgatcagcttgtctgtttctgcaaaaaaaaaacaacaacaactggggattttggtagggatttcattgaatctgtagatcattggccacttgattttaaacaaaatattgagatatctacttcttgaaatgattgcttgagacagtacctgtgtactccttgctatgaaaaatgaggaagttaacatactcatcttccacctttccttttccttactttttttgttgaagtatcattgtggacactttcccagttgacttccacttgatcccctgaattaactaactggcactggcgtttcctttgtaaaatgtacaatgtcagccaccatcttgctactaaagtgtggcctgtggaccacaacatggggggaatctcaggtctcacctcagacttgctgggtcagaacctgagttttgagaggctctgggcaaccggcacctctcagacctgctgttgggttctcatcgatggacccgatgcttcctagcaaatgatacctgttgtatgtgttattggtaataacatagtttacttagctattacattaattaataaaacatgagcgctgaaagagttgtttctgtgaaaataagctgattgctttaaaaagataagagacaaatcaccaaaaaaaaaaaaaaaaaagattaacacttttgggtgagacagtagtaaggaaatacagtaaaaatccagaagggctctgtgctctgatgcttcaggagtgtgtctaagttcttgctcgctttaaagaagctgctactagaaattatagatcatgattatcgatgtggttcatacaaaaaaaaaaaagaaaaatccctgggaaactccaatgagcaggtataaactcacgctgggcatggcggctcagcactttggaaggctcaggcaggagaatggcttgaactcgagtttaagaccagcctgggcaacatagtgagaccttgtctctgcaaaaaataaaaaaaattagccaggctgggtggcacacacctgtagtcccagctatttgagaggctgagatgagaggattattagaccctgggtggttgaggttgcagtgagccatgatcatgcctgagtgacaaggtgaaaccctgtctcaaagaaagaaagagagaaaagccattggctgtacacctagagactggccag

SEQ ID NO: 46670 - DNA, 2487 bp, Homo sapiens
tctattttttggctattataaacaatgctgccgtgaacatttgtgtccaactttttgtgtggacacgttttcatttctcttggatacacactagcagtggaattgctgggtcatacagtaactctatgttactttttgaagaaatgccagacagttttccaaagtggctgcaccattttacattcccaccagcatatatgagggttctagtttctccacatcatctctaatacttgttgttgtttatctttttgattatagccatcctagtaagtttgaagaggtatctcactgtggttttgatttgcaatttcctaaccatttgatgacaaatgatgttaagcatcttttcatgcacatattttctttggaggtttgcctattcaggtcttttgcccattttaaaattgggtttatctttttttttttttgagatggagtctcgctctgtcacccaagcaggagtgcaatggtgcaatctcggctcactgcaacctccgcctcccaggttcaagtgattctcctgccccagcctcctgagtagctggattacaggtgcccaccactacactggctaatttttgtatttttagtagagacgggtcttaccatgttggccaggctggtcttgaactcctgacctcaggtgatccacccaccttggcctttccaaagtgttgggattacaggcatgagccactgcacccggctgggtttatgtttttatattgagttgtaggagtactttattcattttagctagaagtactttattcattttagcttatcagctacatgatttgcaaaaattttctctcattctgtggattgtcttctcactttgttgatggtatcctttgaaccacgtgcttttggtgtcatatctaagaaatcgttgcctcatccaaggtcatgaagatttacctctatattttcttctaaagattttatggttttagctcttacatttaggtctttggtccattttgatttaatttttatataaggtgtgaggtaagggtccagcttcattcttttgcacgtggatattgagttgtgccggcactatttgttaaggctgttttcctctgtttaatcatcttaaccctttttggaaattaattgaccataaatgtgagtgcttatttctggactctcatttctataccattgaactataatatatatctgcccttacgccagtaccacactaattactatagcttcatagtatttgaaatcaggaaatacaagttctccaacttttgttctttttcaatattgttttggttattgcaagtctcttgaatttccatataaattttacgatcagcttgtctgtttctgcaaaaaaaaaacaacaacaactggggattttggtagggatttcattgaatctgtagatcattggccacttgattttaaacaaaatattgagatatctacttcttgaaatgattgcttgagacagtacctgtgtactccttgctatgaaaaatgaggaagttaacatactcatcttccacctttccttttccttactttttttgttgaagtatcattgtggacactttcccagttgacttccacttgatcccctgaattaactaactggcactggcgtttcctttgtaaaatgtacaatgtcagccaccatcttgctactaaagtgtggcctgtggaccacaacatggggggaatctcaggtctcacctcagacttgctgggtcagaacctgagttttgagaggctctgggcaaccggcacctctcagacctgctgttgggttctcatcgatggacccgatgcttcctagcaaatgatacctgttgtatgtgttattggtaataacatagtttacttagctattacattaattaataaaacatgagcgctgaaagagttgtttctgtgaaaataagctgattgctttaaaaagataagagacaaatcaccaaaaaaaaaaaaaaaaaagattaacacttttgggtgagacagtagtaaggaaatacagtaaaaatccagaagggctctgtgctctgatgcttcaggagtgtgtctaagttcttgctcgctttaaagaagctgctactagaaattatagatcatgattatcgatgtggttcatacaaaaaaaaaaaagaaaaatccctgggaaactccaatgagcaggtataaactcacgctgggcatggcggctcagcactttggaaggctcaggcaggagaatggcttgaactcgagtttaagaccagcctgggcaacatagtgagaccttgtctctgcaaaaaataaaaaaaattagccaggctgggtggcacacacctgtagtcccagctatttgagaggctgagatgagaggattattagaccctgggtggttgaggttgcagtgagccatgatcatgcctgagtgacaaggtgaaaccctgtctcaaagaaagaaagagagaaaagccattggctgtacacctagagactggccag

SEQ ID NO: 46671 - DNA, 270 bp, Homo sapiens
ggttttcagttccccagtgttatggaccaaattgtgcccccctccaccccaatctatatgttgaagccctaactcctatgtgactgtatttggagataggtcctttaaggagataattaagattaaatgaggtcataaggataaggtcttatggggctggtgcccttgcaagaagaaaaaaaaatgccagagattgcgctctctcttttcacacttgcacacaggagaaaggccatatgaggacccagcaagaagttggctatacatggg

SEQ ID NO: 46672 - DNA, 105 bp, Homo sapiens
gaactgtagcttcttcattcctacagtgcagttattgtgtgggatagcctgaggatttggggtagtgtacttaacacactctgcacagtgcctgtaacagtgtag

SEQ ID NO: 46673 - DNA, 779 bp, Homo sapiens
aatttttcaaatattgacctgccttacacaatatggaagactgatgcaaggatttctgaggaggagttatgtagatgggcctctttagatccagagtgaagatattagtgtcttgtatgaaagttcaccaaagggcattcatggtagacaaggcttccatgtgtcatctcgtgtaagaagaattgtaggtgttttaaccacgtccccagctagggtctcattgccagacgtgagtgagccttctgatgattatagctcccagtctttgagccctcccagctgatgcagaatgggacagagatgagctgtcccctccagctcctaccctaatggcagacttgtgagtcagataaataatgttccaagctactaagttttggagtggtttgctatgtagtagtgggtgacctgaacacttggctacttgccattgcgattgccaaatctgccattccctgatatggtgtatttcctgaggttacaagccagccacttggtgacaggttaattacgttggaccccttccatcatcaaagggatgccagtttttcctcactggaatagacatgcattctggatatctggatttattaatataatattaatactttccctgtctaatgcttttgctaacacaatcatccgtgaacccagaaacctttattcatggtattccgtgtaacattgcttctggcatacactatcagcctgagaaaatggaatgagctattgaggagtcagttgtggtgccagttgggagacctgaaaagttgaggttc

SEQ ID NO: 46674 - DNA, 390 bp, Homo sapiens
aggatcacttgaggccagcctggaattgtagtgagcacccccaacccaatctctaccaaaaaaaaaaaaattaaattagccagggccagatgctgatggctcacgcctgtaatgtcagtgctttggaggctgaggtgggaggatcccttgagccctggagtttgagactagcctgggcaacatggtgaaaccccatctctacaaaaaatacaaaaattagctggcacagtggcgtgcgtgttgtcccaactacttgggaggctgagatgggaggatcgcttgagtccagggaggttgaggctgcagtaagctgtgactgcaccactgcactccagcatgggtgacagagcgagaccttgtctcaaaacaaaaaaacccccaaaaacccaa

SEQ ID NO: 46675 - DNA, 815 bp, Homo sapiens
gccagaagggcagcaggccctcgtagggtccggcgtctcacccacccgtgtctcctttgctgtccctagcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgc

SEQ ID NO: 46676 - DNA, 1245 bp, Homo sapiens
ctggagacccggacctcggctttcaaagcggctgggtgggaagagctgtttatataaacagagattccgctgtaaatgcgctaatatcccggctgccagcgcatggcgagcgcctcccacgcccatccgtaggagcggcgtcccggccgcccctccgttcccagcctgccctgcccccgcctccttcccctcctcggccatggccacctctggacgcctgagcttcaccgtgcgcagccttctaggtttacccgagcaggacgcgcaacacctgccgaggcgggagccagaaccacgcgccccccagcccgacccctgcgccgcctggctggattcggagcgcggccactacccttcctcggacgagagcagcctggagaccagcccgccagactcgtcgcagcggccgtccgctaggcccgcgtctccgggctcggacgccgagaaaaggaagaagcggcgggtgctattctccaaggcgcagacgctggagttggagcggcgcttccggcagcagcggtacctgtctgcgcccgagcgcgagcagctggcgagcctgcttcgcctcacgcccacgcaggtcaagatctggttccagaatcatcgctacaagctgaagcgcgctcgcgctccaggggcggcggagtcgcctgacctggcagcatccgccgagctgcacgccgcgcccggcctgctgcgtcgcgtggtggtgccggtgcttgttcgcgacgggcagccgtgcggcggcggcggcggtggcgaggtgggaaccgccgcggcccaggagaagtgcggcgcccctccagccgccgcctgccctctgccgggctaccctgccttcggtcccggctcggcgcttggcctcttccccgcctaccagcacttagcatcccccgccctggtctcctggaactggtgaggccgcagggcggcacctggggctaccctcgactttggagcgcgctctgcgattggagcagggccggagccgaacgcctggaacgctctccgtccgcctccctgcagccccatctccttgggcgccagggtccctggcgcgccctcatcagccgtcgcgcaagcacacacgagggacgtgtgccagagccccctccctcaccttccctccaccgccagccccagagttagattttatgcttgggccttatttgtatatttttaaatagcgatttgtataggaagcaagttatttttttaaaaaatagagtatttttcctcgtagtt

SEQ ID NO: 46677 - DNA, 540 bp, Homo sapiens
tggccaggttggtcttgaacccctgacttcaagtgatctgcccgcctcagcctcccaaagtgctgggattacaggcgtgagccactgcgcccggctcaaattagttattttagagaatattacttttaatctcaaaactgtttctttgaattctgcctgcctatccgattggttttactgaagttttccttgaggggctgtctgtcatcttttagggccctctgtcaagtttttttcaaaaataacaactgcttagttgtgtgcagtgtaggactctttataggtttttgactactcttcttttcttgtagaatttcactgtcttttaatgtttacagactgcaagcaggataaaattaaaaattcaaccattattaatattgctgctttgtaggagctggtaaaggagtagaaggtaaagatctattaattatagtgtctaatacacccttgaggaaaatctgttaactccaaattattaagtacctaaagaaatctggagatcttaatttatttgccctatttcaggccttaccaaaa

SEQ ID NO: 46678 - DNA, 353 bp, Homo sapiens
gttttttgctgttgtaaacagtgtcctagtacaaaccctaatatgtgtcattttagacatgtgctagtatggctatagaataaatgccttgaatttggaattgcttatagaaagggggtggggatttcagaataaccatgtgttgaataagcttttatccacctttttgtatgctaaatcctgtgtgcatttgattctatttctgcactttatgttctcttaatttgcctgtcaaataatgtgccaatatcacagttttaattattgtacttttataatgtacatgtatacattataatgtataatggtagttaagggtatagacttgaactaagctgcctagctttgagtct

SEQ ID NO: 46679 - DNA, 505 bp, Homo sapiens
ccagacaccgcttgtactgagtgagcttgggagagctcgtggtgagtgccagttgcttccctgcctccggcccactggccctggtgtgaggcaccacccagatgaggagaggctgcgggatggaggtccagggctccgcctggagcccccctgcctggtgtcctggccacatcagctcatttgctgtgggactgtgagcaggcccctcagccgggttcgtcaggttgtggagaagctgaatggagcagataacctggaaaacacgcggtggattgccgagaccttctttgtgcctcgcccatattagccaaactgtcccttgttctatcagctgccatgtgtgtgtaagccagagtccaccctcttttccatttgagaaatcacgtctgcatgtctccagtatgtctcctttttcaccatgatttctcagagatcactccctgcggtttaataaccccctgggctaattcttcccaggacatgggaggacattttgtctggcttg

SEQ ID NO: 46680 - DNA, 470 bp, Homo sapiens
agggtcttactgtcacctaggctggagtgcaatggcatgatcatggctcactgcagccttgacctccccaggctcaggtgatcctcctacctcagcctcccaagtagctgggactgcaagtgcatgccaccacgcccagctaacttttgtattttttttagaggtggggttttgccatgttgaccaggctggtctcaaactcctgggctcaagccatccgcctgcctcggcctcccaaattgctgagattgcaggcgtgaaccactgcacctggccccattttctacatttaaatatttacgtttacctacatgtttttttaatgtggctagtactgttccttccccccaccaagagacatattgggaaatatagagttctttataggttatcaccgtgactgagaagtcactactggtatttcattgctcagaaggccagagatgtcttgccagagtcctgtagtgcag

SEQ ID NO: 46681 - DNA, 370 bp, Homo sapiens
tcctatatacacattccacagggccaactgtaggacttgagtgtgtatggatttgggtatactcaggggtcctggaaccaataccctgtggataccgaggaatgactgttaattgtctacctagaaaaccaagagcaccaacttaaaaatagcaagatttaatatgagaattcagagactggccagttacaaagttgctgatcaaccaaatcagaatcccagtgaattgaatacattcattgaatgaatgaaataacagttgtaatcttttactaggctgtgactgcacagcctagtgcatttcacccattcatccaggaaaaatttattaggtgtctgttatgcttcaaacactgcagatgtcaagaca

SEQ ID NO: 46682 - DNA, 390 bp, Homo sapiens
tacataggatcataattaggtatagtttgccatatatttattcaataattaaatatcagtttcttatcgtaagaaaatatcagaacagtttcatcatgttggtttaggatcccacctcatatttccaactaagggtttgatttattaaatatttcttatgcatgcaaaatctctccataatcaaggcacaaaaggatgttagaggaaatacaaaattaagaatttggttgttttcaaacacacttggagagaaatttacatatacatgtgtaccatcataaaatgagcactgtgtccacttggatttgctctaaatttacagatcaagtaaatgatctcacctgcatgtgagacggcaggtgaaagtaactcagtgaacctctaaaccca

SEQ ID NO: 46683 - DNA, 470 bp, Homo sapiens
atcaagtagcattgatcaatggcatgattccaactcagatttgtgggacaccaaagcccaggatcttcccaagtgccctgctgcagtttagcaggtcctctccagctaaagagcagtgagacattgggagcccaggagtgttgaggccaggccaggctgaggcccatcagtcacaggtgtgactgggctgcttgtcacacacagggcgtggtctggccactgttgccagtgctcactcagcggccacatgctttttaatatgacccctgaggcactgaaaaataaccccaggccaactgcaggatagagagagaggtcaggacagcagccctgtgggctgcatgatacactgtggctggagttattgtgaccccctggtgcagtgctcccacggccagtggtgcacacagggccattcactgtccatagactgaaaccatgtgaccatttgagagggccgggcacacttt

SEQ ID NO: 46684 - DNA, 270 bp, Homo sapiens
ctttggcccacatgaatgatcaacaggcatgattaaagactaaagagtttattattcttggccctcgacattggttttgtccaggatcaccctcttgtcatttattaattgagaaaaaagttaatcatcagcagacaatggtccttttcttttctaacaatgatgctacttggttattctcattcatagagaagaaaactgtgtgaccaaaatggctaagaggccaaacaatgttacatgacatacttccatattaaaactgattagcaa

SEQ ID NO: 46685 - DNA, 271 bp, Homo sapiens
agaatgagaataccagaggcactaacttggcctttgagggaacatgaccggtgggccgcactgcatttccatttgttcccagggcatctctggccttcagctgaagtctctgcagtttcataaaatttgtttcctgagttaatttacctccccaaatggaatttaagcctcttgagggagaaaacagttttaaacatttctgacattctctgtggtccatagtactgttgagtgtggattgtggactctttttgatttgatggctttgtgc

SEQ ID NO: 46686 - DNA, 352 bp, Homo sapiens
gatatgactactctaacagtaataactataaatctcactttaaataatttaaaacaaattaaagtgatatatgagttaaatgaccaagcagacttgattctaggaatgttaaggaatgttcattatttgttttggataatgaagtcagcagaggaaaaaaaaatatgaccatctcaaaagatgccaacgttgtctttgataatatttaatatattttttaaaaaacaattcttgtaaaatacttttttgattagccttctgaccatgattaaaatggtgtacctcaaagtagctgctaaccttatgtgtatctgcaacaccctgaaaaattatctaataaaaaggcacaaag

SEQ ID NO: 46687 - DNA, 448 bp, Homo sapiens
atgaatttagaatagcacactttttccattcagatttcatacatttgagccaaattcttatactccatgttttaattttaaaaggataattttaatccaagatttaaatctttgaaaatatctttcttatagaaaactttaatgcagtttttaaacttactgatttctgtggaaaacctttcttttctatagaaatactgtagtgccctttcttcccatcttgattttgtacatgtaaagacaaatgatgattcagtttcaatattgcatgaacaattgccactttgtaaattatatggacagaatgtgttctaaggaaattcgttagtaaatttgtgaaaaacatgtgagattgttcgagacctattaggctattcttcagttttgatgctcagttttacaacttaaatgattttctccaggacacggagctcagaataataaagct

SEQ ID NO: 46688 - DNA, 265 bp, Homo sapiens
caaaaaaaaaaaaaaaaccaaaacaaaacaaaaaaaaaacaaaaccccaacagaagcacctaagcctttcttctcgctagcagggcatagcccatgtttcactgagtcctggacctccttggtcactacccactctctggccactatgctggcccagcctgttgccaccatgtcttgttggtcatcctgtcatcctgtttgtagtatgggctgaagcatgaaaaaggcattggagcacgggagtaagagtgccctttccaaaatg

SEQ ID NO: 46689 - DNA, 592 bp, Homo sapiens
atactttggattccaaagtatttccaataccttgaagattcctttgaaaacatcaaagcacaaactcaaatctgcacaagattacaaaagcacaattttggtgttatttttagaatgcaatacacaaagctatgttcatttctctcagcaagcattttcctgggtagtagtaatagcttaggaatcaaatgccacttttgtttttccttttttcactagtttgaaataccacaaatcacaggtgagtcagtcctcccagaggaaaagacagtcctagggagaatcacaggcctggcagacaagaccacactgagagcagtagaaggaacctgcatgcttaagggacagaggactgtgttgtgttctcataatagaccgctggatgaagaagtggttaaaaaccaaccctcgaaaaacaaaaatccctggctaatcctgaaatatatttaacttgaagtctttggatgatttttttaaggttaaaaaaaagtttaggattattataaatcaatatttataaataagcaacaatgtatttggaatttttgtttacctgattaaatatgtttttggtatgtgtaaaaaaaaaaaa

SEQ ID NO: 46690 - DNA, 601 bp, Homo sapiens
actaagtttcttctttttctttttctttttgagagggagtctcgttctgtcgcccaggctggagtgcagtggtgcgatctcagctcactgcaacctccgcctcccaggctccagcgattctcctgcctcagccttctgagtagctgggattacaggtgtgcaccaccacgcccagctaatttttgtattttagtagagacagggtttcaccatgttggccaggctggtctcaaactcctgacctcaagtgatccacccacctcagcctcccaaagtgctgggattacaggcatgagccaccgcgcccagcctaatactaagcttctaatcttaatttcaaatatatccacattttttgttattctcatttattttcaggacatttttaatgaaaaatgtcataaacaaaaaaaggagcattataacactcagtactgaccactcagaattaacagttgctaaccttttttatattggctggagatctttttttaaaataaaataatacagatgtgatttgaagtcccttctccgtcttacccaatccctttcatttccctctccagaggtaattactaacatgaaataggtatatactctt

SEQ ID NO: 46691 - DNA, 435 bp, Homo sapiens
cattctaattaatattaattaatattatcttttcttttttgtgtgttttatttttaaaaattaatattagagtgaacaaaaatcactgtttgaagatagcatggttttgtatttagagaataaaaaaggctaatcagaagcacagagactacttcagctgtatttataatgttttatttaagcaggatggtggccatatgatagatgacactgacactcctcattaaagatgacagtttgaggccatgcgtggtcgctcacgcctataatcccagcactctgggaagccgaggtttttgctcgaggccgggagtttgggaccagcctgggcaacatagctctacaaaaagataaaaaaattagctgggtgtggtgggcatgtgcctgtagtcccagatactggggaagctggttgggggggatcgcctgagccca

SEQ ID NO: 46692 - DNA, 517 bp, Homo sapiens
ctctgaggaaggtagcatagtgtgcagttcactggaccaaaagctttggctgcacctcttctggaaagcctggccatggggctcttcatgatcattgcaattctgctgttccagaaacccacagtaaccgaacaacttaagaagtgctggaataactatgtacaaggacattgcaggaaaatctgcagagtaaatgaagtgcctgaggcactatgtgaaaatgggagatactgttgcctcaatatcaaggaactggaagcatgtaaaaaaattacaaagccacctcgtccaaagccagcaacacttgcactgactcttcaagactatgttacaataatagaaaatttcccaagcctgaagacacagtctacataaatcaaatacaatttcgttttcacttgcttctcaacctagtctaataaactaaggtgatgagatatacatcttcttccttctggtttcttgatccttaaaatgaccttcgagcatattctaataaagtgcattgccagttttc

SEQ ID NO: 46693 - DNA, 382 bp, Homo sapiens
acaagtgaaaccaaggcagaaaaagacatggccaagtcttgtctagccggttagcctaagcttttctggtcttttgtaagtgactcatttcccttttgtgtggttttcttaatatattctgcataaggctggctgttacatccaaacagaagcaaaatgtatgatctgagcatgcactgcctcttgatctaatccacttcttaattacatttatgttcattgtctttgagtcctatagtttgggacaattctacaggctccccacccctagaagtcatttattatcagctaccagccactcaatgtttagttatagtgaataaaatactttcagtgtcagaaactatagatctcatttctaactctagattaattctgtttc

SEQ ID NO: 46694 - DNA, 409 bp, Homo sapiens
tcttgaactatttagtgaaataccctaacttctaatcttgatattaaagaaaaaagaatttatggccagccaccacgcccagctcttcagtgactttgaaagtgaggaacacttttaggaaatgtatcagctgggctatccttactaggatactggaactccgtgctgttaagctggccaatacatacctcccagatcctgttggggaaacctggaatctgtctcctccctaccccgtaggagaaaccttatatttcctactcacctgcactgctagtcagagttccattagcatgggatggatggaactctgtgtgactttaaatattcctttaagttttatggtattactataattctgggagttgaatggggtttgtgattatgcaagggtcataatcacatttga

SEQ ID NO: 46695 - DNA, 200 bp, Homo sapiens
agaaagtcaataattccctgcctcagcctcctgagtagctggggctgcaggcctgtgccactgcaccaggttcaatgtatattttattttgtcttttttttctttttttaatgtatattttttagcattcctttgttgttagaaattacattgtttatataattattatttgtcaattaaaaataaaagaaaaaatcata

SEQ ID NO: 46696 - DNA, 937 bp, Homo sapiens
tttttttttcgcttatcatctatttttagcgttagtgtattttacatgtggtccaagacaataattcttcttctgatttggcccagggaagccaaaagatgggacaaccctgccctaggccttcacattcactctctactaactcactgactcacccagagcaacgtccagccctgcaaactccattcatggtaagtgttctaaataagtgtaccatttaaaaaaatcttttatatgccatttttactgttctttttctatatttagaaacacaaatacttaacattatattaaaactgcctacactattcagtatggtaacatgctgtacaggtttgcatgcttccctaataccatccccttccttctcttgctgaagcactgtcagtgacatgttttaaagaagataataaaaacagtagcacagctttacatgtgttgaatggttaggaaatatataaataccataataaacatgacattttatcttaaaaaagattgtctgcttgtggaagtggaattcagaagagttgcagcttgtgagttattatcaagtggtgcaaggagggttatccaaaatctgccagaaagttttaacagcaagagtaaacgtcttttgtttaacacagaagttatgtatagatacatccttcacatatatgcacacagaatgaagtacagtcaaatagacctaagaataatattgaggctagcaaaagtgatagtgttcagtgacagtcaacaatggaaattttatgcataaaaataagaaaactaattacaaacacatttaaaaattgggacaaaatatacacagcaaaatgcataaaaggcacagtttttattcattactttttatttctgaaaaaattcataactttatatgatcttttgtatttattttttatagttgtactttttctaaacaggtgaattt

SEQ ID NO: 46697 - DNA, 747 bp, Homo sapiens
ggctctggctctctctcgctagagggatgccaccgccctgtcctcccgtcctcagcgttgccttcccctccctctttcccactgacgccttgaaaacccttatttgcgcattcactcacgcttgaggtcactctctgaaagagaacaaagtaattttctgaagggaagctgcagaatatggaaaacatatattggagctacatggatgtaagttcaaacctcacttcaacctttagctgcaaagttcttgccctttaattgaatcataaaattgagtataataatacctaccttaagggatttttatgaagattaaatgaaacaatttgtgtttattgcctgggacgtaatagccattcaataaacactagtattgtttattgatgacagggtgaattgtacagtatgtgaattatacctcaataaagctattgaaaaaaggtgttaggggctttgaaggcaaaactgtgctctccttcattgtataaacataacataaccaagtagcaataaatcatttataccctaatgtccactttcccttaagagaaaatgcatttttgaagtgttgacagctacaaccatacaatgaagtaaaataatattttcttcacttgcaccatgctcaaggcagcaggttaactggatatagacgtgtaaattcaatgccaatttgaattatacatcagatttatggagccgttttgtagacctaagtaactgccatcagagtcaggaaagagataa

SEQ ID NO: 46698 - DNA, 418 bp, Homo sapiens
ggctctggctctctctcgctagagggatgccaccgccctgtcctcccgtcctcagcgttgccttcccctccctctttcccactgacgccttgaaaacccttatttgcgcattcactcacgcttgagggttaaaagattaagagtttctctaaccacggctaccctctaaaagtcacattttccccctttttccagtcactctctgaaagagaacaaagtaattttctgaagggaagctgcagaatatggaaaacatatattggagctacatggatagaggatcacatgaagccaagagttgaagaccagcctgggtaacacagtgagacctcctcatctcaaaacaacccagtgtggtggtccagcatgggtgacagagacccatctctaaaattaataaacaaataaatctctaaac

SEQ ID NO: 46699 - DNA, 372 bp, Homo sapiens
tatcatgccaaccttgaattgagagttttaaaacaactttcagtgactgctatttctggcttttctcctgacaggttaaaagattaagagtttctctaaccacggctaccctctaaaagtcacattttccccctttttccagtcactctctgaaagagaacaaagtaattttctgaagggaagctgcagaatatggaaaacatatattggagctacatggatatttcaaggttgataaagaacctctacatgaaaatattgaaatgtttaagcagcctctgaagtctttcttaagcctcataataatggatggactttagaaagctaaaaatcatttcaaatatgctgatcatttttaaatttttatactca

SEQ ID NO: 46700 - DNA, 350 bp, Homo sapiens
ggctctggctctctctcgctagagggatgccaccgccctgtcctcccgtcctcagcgttgccttcccctccctctttcccactgacgccttgaaaacccttatttgcgcattcactcacgcttgaggtcactctctgaaagagaacaaagtaattttctgaagggaagctgcagaatatggaaaacatatattggagctacatggatagaggatcacatgaagccaagagttgaagaccagcctgggtaacacagtgagacctcctcatctcaaaacaacccagtgtggtggtccagcatgggtgacagagacccatctctaaaattaataaacaaataaatctctaaac

SEQ ID NO: 46701 - DNA, 1006 bp, Homo sapiens
ggtgatgatattcagtgggtataaagtttcagttatgcaaaatgaggaagccaaaagatgggacaaccctgccctaggccttcacattcactctctactaactcactgactcacccagagcaacgtccagccctgcaaactccattcatggctggttttgaactgctcgcctcaagtgatcctcctgccagggcctctcaaagtgttgggattacaggtgtgaaccactgtgcccagcctcctttttaacagaaggaaaagccaaaactcagagaggttatataacttatcaaggtcatgtaacactactcggataaatgggagaacgagtctggcgaagtggcttcagaggaatgaatatgagacacagaatgtgaattacagtgtcactctctgaaagagaacaaagtaattttctgaagggaagctgcagaatatggaaaacatatattggagctacatggatgtaagttcaaacctcacttcaacctttagctgcaaagttcttgccctttaattgaatcataaaattgagtataataatacctaccttaagggatttttatgaagattaaatgaaacaatttgtgtttattgcctgggacgtaatagccattcaataaacactagtattgtttattgatgacagggtgaattgtacagtatgtgaattatacctcaataaagctattgaaaaaaggtgttaggggctttgaaggcaaaactgtgctctccttcattgtataaacataacataaccaagtagcaataaatcatttataccctaatgtccactttcccttaagagaaaatgcatttttgaagtgttgacagctacaaccatacaatgaagtaaaataatattttcttcacttgcaccatgctcaaggcagcaggttaactggatatagacgtgtaaattcaatgccaatttgaattatacatcagatttatggagccgttttgtagacctaagtaactgccatcagagtcaggaaagagataa

SEQ ID NO: 46702 - DNA, 330 bp, Homo sapiens
gttgctgatttgtacatgtttatgctgacaattttcagataaatgttcctgcttaattgcctaatattaaaataaatataaccttgtttattttttgaaatcctatgttccccaggctggttttgaactgctcgcctcaagtgatcctcctgccagggcctctcaaagtgttgggattacaggtgtgaaccactgtgcccagcctcctttttaacagaaggaaaagccaaaactcagagaggttatataacttatcaaggtcatgtaacactactcggtgggtacacaaagtcccgcactctagttttcagactctaaagttcagtgttc

SEQ ID NO: 46703 - DNA, 301 bp, Homo sapiens
aagaaaaagaaagaaagaaaggaaaagaaaagaaaagaaagaaaagaaggaaagaaaaggcatattttccatgaggacaggaagcatatgtcttgtggttactgtatctgcagtagcagatgctcaataaataaagggaccaatacttgtttcactgaatatctgggagaagtaaggcaaacacagtatgtaagcactgtgtaagctcatagaaggcccttacccagtgttttaatgggatcagttaaggttctactcttttctcactgggtacatttagtctagatccttcatctctctg

SEQ ID NO: 46704 - DNA, 237 bp, Homo sapiens
acctatcaccatcctgactgcagggttaacctgcttccaagttaactctctagagcaagaaaaagaatgctttttctggcttccctcagatggaattgaaacagaccaaaaattttaaaaatactttattgaatgataaaacagaaatgcacatagaatatgagacatatcagtggtctggctcacaaagaagagatatcatatcttgcaagccagggtttcatatgccttttgtat

SEQ ID NO: 46705 - DNA, 651 bp, Homo sapiens
agcacaatattgcattgtgtatttactaaacagcttttctgagtaacaaagaaccctaaaatcttaatgggttgaaacaggtattcatttcccttttcaattactttttggtggctacagaacggctgtggcagagctctgctctaagcgtcttctcgttgggagatccattttgaaataacagttgctcagtgacaagcccttcctgtggtggaagggaagaactggacgctgagccaacctatacagtgcatttaaagctgctggaatgggacatgggccctatttgttcatagtccactggccaaagcaagttacatgggtgtggtcaacatcaatggagtaggaagctttccttgggaaaccttgggagtaggatatgcagtagatatttgtgaaaagtagtatttttgatactcttgatcacaaatattctttttccacatacaaaatacgtttgtatatagcaatacaacaaccacattccactttcttgatcacgaatactcattcccctccaaaggcagaatatactcaactcctccccaaagaatagttacccagacatagcctatgtcactttctttaagacttttttaatatagatatagatgaacacatatttaagtgtggtcttcttttttacctatt

SEQ ID NO: 46706 - DNA, 496 bp, Homo sapiens
  misc_feature (316)..(316): n is a, c, g, or t
tatttttggatgtatttttcagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagntttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaatgtcgacgc

SEQ ID NO: 46707 - DNA, 558 bp, Homo sapiens
  misc_feature (427)..(427): n is a, c, g, or t
tggcgggtggcttctttctcctcggcttcctcttcggttaaaagccaactgcaaggtctaatgactgcaggatctagctatccattgtttctggccgcctatgcgtgcactgggtgtctggcagagaggctggggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagntttcaacacatcattatttgaaccacctcctccaggatatgaaaatgtttcggatattgtaccacctttcagtgctttctctcctcaaggaatgccagaggtaaaaacacagtgcaacaaataaaaatgac

SEQ ID NO: 46708 - DNA, 594 bp, Homo sapiens
gcactgatttttattttggtgaactgaaacaggggtctaacaaactggtatctcatttgtctttataaacagaactgccagattggctttgcaattcagggccctgtagggtgcccacctcctcagtttgggcagcagcattacatctgagtcttagaataaaaatggaaagcaatggctcaacccattggtttgtcaccatccacatgaaggatctctattggtaaaaaaacagactcccgtgttcaaggccctggggctggaatcaaatccatcattcatttatttcggttttttaaggctaaatacatagggaagaaaatgaaatgtgagaaagctgtgcattttcaatgtcatcttgaaagtgagtatctttagacacataaagtagatgagtggttaacttgggctgggagagggagtgaggagtggttgtacatggcacaaggtttctatttagtgtgattgaaatgttctataatttgattgatgattgtacagttctgtaaataaactaaaatgtattgaattgtataattaaaacatgcagattttatatttaaaatatactttgataaaagtgttttaaaaatg

SEQ ID NO: 46709 - DNA, 355 bp, Homo sapiens
accggcggtggtcactaagtctttgttttcccacactcttgggcattttccaacttctaagcaaattcccttgtacttccttaatgacatcaagggacattaaacattccctctcaatcgtttttaaaatcgttaacttttttttttttttttttgaggagtctcgctctgtcacccaggctggagtgcagtggcccgatcttggctcactgcaacctctgcctcccgggttcaagcgattctcccgcctcagcctcccgagtagctgggcctacaggcacccgccatcaaacccggctaatttttgtatttttagtagagacgtggtttcaccatgttggttggccaggctggt

SEQ ID NO: 46710 - DNA, 714 bp, Homo sapiens
gagccaggcccttggttgtttctgagagaatacaagggacaccacagggagctatcttccactccagttctggagcactcaggccattggggagctcccaaaagatggatttgccctcctatgtcactttggcttttctgtcccttttgttttgcactaaccaattttggattgtcagacactgtacaaacaaggcaggataaagattgttcacaacagtagatgtgtaatgagcgaaatgaatcccaggtttcctctttgaaagggtctgcactcaagtttttggatgtttaacctggcacctgtccccctttcgtaccctgggctgacttcttggagtttgtgtccttgcaccctgaaacaatccacctgtttcctcccacagaatgtcttctcccttcacccattcttttcctttggaacattttttctttctagttagcagttgaagcagtgatgttgcaagaacaccagttccttttacagggtgacctgcctgcgctctgtctcacttggcactgtggttcatttcattacagtgtaaagggccaaggcctgcaggggcctgataatcataaactgtgtgtgttgcaccatttcatcccctggcatccaagaaatagaaactcagaatgctggcagttttgccgggaacacacctcctctctaatgaggaaagatttcattgtccattgtttatttaaaacaaaggca

SEQ ID NO: 46711 - DNA, 353 bp, Homo sapiens
tctctgggaaggtggagaaccaggtttggaggacactggttagccaggccctgctagccgggccccatttccccgtaatgtctgtgctccgaggttgtcaccagcagatgcaggagaggctgggagagcaagtttctggtgctttcagcccctcgtctgggccacttgcttttcctcaagagtggaccatttcccatccataggaagaggctcagatgctgggtggccagcatgcctgacaaatggcaacagcatgataaaacccttgacagctgtgcctcgagatctgaagagagcagtttcgcattcgcttacatggtggtggtaatgctccttccctctagaattatcag

SEQ ID NO: 46712 - DNA, 399 bp, Homo sapiens
cggcacgagggcctgctgtttgggttgaaaaatgaagtagacactggcagagaggtggggagggcccagaccagaagctggagaggtggttcagcactggcccttggcagttaattccggttaggacggagagccagctcctcatgcctcctcccatcccacctgcccggcccttcactgagaacccactgcccgatgggagcctgggtctccctgctcctcctcctgcctgggcacttgctccagccaccctgtattgactgctctccccagatggctgtgtcctcagagctcagacagcggggctgacctcacgcagctggcggggtagagccaaggttggaatgcaggttcctgctctgtgcactcctgtcctgggcccctgcctgacagccaagc

SEQ ID NO: 46713 - DNA, 384 bp, Homo sapiens
tcggaggcaatggcaccacagcccttggaaacagaagtgtggcccagcccattccagccacctcacgagagcctttcgccttcaaagttaggctgctgtgcctggaacttctgacaggtcccggagagtgccgcacacacacgggacctaccgcagaaagagctttgtaacagaagtactcacttgggggcaacactacctgagagtattctgtcgcctcactgcaattcagctaaagtgaaaagaagtcctaacccctccccgtggtttccagcccctcacctttcctttgtattgattttcttccctgttgtactgggcagaaaagacacacacaatcttgcagcacccctcgcagtcacacacacgccataacaaccacac

SEQ ID NO: 46714 - DNA, 422 bp, Homo sapiens
  misc_feature (345)..(345): n is a, c, g, or t
  misc_feature (393)..(393): n is a, c, g, or t
ggcgtgggcaccacgagcgagtcttgggctggggcgcgtgtcactctgggttcacatggcctggctctcaggacggcatgaacagaaactccacgtggcagatgaatccaccccggaccactgcatttaagttgaagctcatcacttccgcttcccagagctttccccactgagctttctgaggagccacctgtgctcagcccaccccgcctgccagccttgctgccccgacacgcatagcacccacagcagtgctccgcgtgggtgtggggaggactgggctgcccagacccccggggccacctgccttccaggggctcagaggtcctaggttggctgtgaggncaaggggcgggcttcgcgttgaaggggaggggcgttttcagggatgtnttagaaagacgggagagagggccgagttt

SEQ ID NO: 46715 - DNA, 332 bp, Homo sapiens
ttaaaatataaattctcccattactctgtcagccataaataccttctttgctaacatgctgttcagaatcactataatctggggagggccattttatattctctgttcacatgatctaagcagcatttttgcatgactttggggaataaaacaggaaaaggggggaaatttaaaaaatacaataagcttaatggctttttcacttatcgtttctttaacctctttaatatactatggggggatatgtactaagcttttgtggaaagggggtcctattttgtaaccaaaggaaagtgaaaaatatttctggaacattttgactttcaacctct

SEQ ID NO: 46716 - DNA, 409 bp, Homo sapiens
catgagaccgtctttggagggaggcattattcagcctgccccagtgctcatctgatcttatttgcagtgagcactgacaaaggccttcttttagagatagcacaaagataaacttcagaatggggagccctgatcgtgaaaaaggtgctggatgaacggtgaggaagccggagttcgagtcctgctcttccacggctgcagggtgtagtggttaagaatacatggacccgttttgaaatcccagatctgacttattaactgagtgaccttgggcaagttgctttactcatctgcggagtaatgaaacctcccgggcggggctgtccctgagattataaatggattactctatgcaaaatacctggcacagtaagtgttttaagaaatgactgcccttcccacccccaat

SEQ ID NO: 46717 - DNA, 768 bp, Homo sapiens
cctcagccacccaagtagctgaaacctagctaatttttaaattttttgtaaagacagcatctcactacgttaccccaggctggtctccaactccctgggctcaagctgtcctccctcctcagcctccaaaagtgctgggatttcaggcctgagccacagtgcgtggcccacttttattactcctatttctattattataggctatccccaaatactttttagaagtaggcagagtatattcacaagtaccttttttaattacctagaaaacaaatctacaaagaatgaagacatgggactcagtttgtgatttcctcatttttaatgtgtggtattatagaggccttactaatcctctgtgattagctgtggaaaattttgctttaatctttgcaacaggttagatcatgagacagcgaacagcaaaaaaaaattgcaactctgtagtattgaaaaaattttatatggcatatttcttgtaacaaagcatagctcaggctgggcgcagtaatcccggcactttgggaggccaaggcaggcagatcacctaagatcaggagttcgagaccagcctggccaacacagtgaaactccgtctctactaaaaatacaaaaattagccggccatggtggtgcacacctgtaatcccagctacttggaaggctgaggcacgagaatcacttgaaccagcaaggcaggggttgcagtgagctgagattacaccgctgccctccagcctgggcaacagagttagactccatctcaaa

SEQ ID NO: 46718 - DNA, 904 bp, Homo sapiens
cgtgtggatcgctttgcaacagatcgcttcttcaaatgctggcacaacgcccagagctcgatgaggtgtgggcaagtagctgtctaaaggtggatgatgccctccatgcactttcagcctgcctggtggctgggcagtcgaaaacgtcgccgtctattaagctcctttgattgggagcaggtgacgggtagagacggaagttctgggaatcaccggagaagggagggaagggctccttccggccgcctgctcccggagtcttcgtggggaacgtgaggtgagagcaggcggtgaagagtagacacgactgatgacttcagggatgctacacctttctctcctgcctgggcaagcctcggtagtaagatttccgtagtccgttttgtatgtggttttgcagaaacataccccctctctgctccagcttcagtcgtcagtatccagctacttccaagagtcttgcccatgtcttgtgggatgttcagcaaatgtataaacacttaatatcccgacaaagcttggcctcttccctcccaaattacttcccaggctatgcacccgtttttgttaatacaaccaacttggaaactttgatgtcagatttgatgccctttcttgcctttccatgctccaatcacttgccaagtcctgtcgattgtacccctacagtaattcttgcatcttcttacccactgcccccacctaatcaacgttctcattaccatcccctgcacggtgtcagtgcagtacctttctcattgatgtcctgcctctagcatcactctgctactagcctatcttacatatacctgctataggtgtagccatcttcaagcaccaccgtgatccaaaatagctgatccaatggctctctgttgcctgtagattaaaggtcaagtttatt

SEQ ID NO: 46719 - DNA, 1130 bp, Homo sapiens
cgtgtggatcgctttgcaacagatcgcttcttcaaatgctggcacaacgcccagagctcgatgaggtgtgggcaagtagctgtctaaaggtggatgatgccctccatgcactttcagcctgcctggtggctgggcagtcgaaaacgtcgccgtctattaagctcctttgattgggagcaggtgacgggtagagacggaagttctgggaatcaccggagaagggagggaagggctccttccggccgcctgctcccggagtcttcgtggggaacgtgaggtgagagcaggcggtgaagagtagacacgactgatgacttcagggatgctacacctttctctcctgcctgggcaagcctcggtgtccgccccagtcctacacccacttcatgccttctgtgagaagctgcctccacacctcagcccagactgagccaatcaggacattccattcccctggccacagtgatgggctcaggaatcggcctgtgccccaaggcagggcagtcagacacggcgaggcttagttcggagactttggcttgacctgtttgggaatttgctagacttgaatgtgagttgggagtccagaagagagcttacctgaggatggagccaaacagaacaagaaaaacccaggagggaccctgcccttgaagaccatagtctagtggaggagacaccttttgataggggtaagggtgacaatgagtgtgatagctcagagcatggggcagcataatcaggatgcccctgggggcacttgcagctggctgggctattcatctggtcatttctatttttgcctcttggaattgaattctgctgggaggcagccagtgaggtccaaagtcctctcctcaaggttgttggattgtttgatgattgactccccacccgttcccagcagctgcagcttcccaggcccttgcattgccagagctccctggctcttctctctaatcaggctcccagcctcactgggggctgattaagacatttcctgtccttccccaatcttggagtcttgctaagatcctcctgacaagcttctcctgcctccagcctgcctttccacaaccttctcccatctgctgccagagaagctaagacacaagtctgatcatgccacc

SEQ ID NO: 46720 - DNA, 601 bp, Homo sapiens
taaatatctgcagttggtttaaaacttttaccaacgctggtggaccaaataaatctgtaagcgagggaggcctgtgggccagcagctagtgacctctgacgttttggtttggtttgcctgcttctctgctgcttcaacgctgcctccatttagtcctcttggcctatcggattcttggggtcagctgctccactctgctttttctccaagctcagccccctagagcccagtctttgatggatctcagctaaactgaaggaacagacttgccactaccaccagttcctagcagcctccagaggctatttggccttcctgggtggaggcctggcccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 46721 - DNA, 884 bp, Homo sapiens
ggaggactagaaactaactccgagcccttaaagggacggcctgctgttagaaggaccctggactccttaaaggggtggcctctttgagccggaggacttgagacacttttaaaggggaggtctgcgtttcggggcgagctttcggccccttttaaaggggtggcccttcctcttcctcggggagacttgcatcgacccctggcagggggtggccaccgcactaggccgccggacactgtcgggtcgtcttaaaggggccgggagctggacaacttggggcctcgccttaaagggacggccgccccgttttcgccgtcgcggccccgccgagcccgcagggggggccctcgggcttgtcgccccgggggcggcgccggctccccgggccgtggccttggggcaagctcggggccagcagatccggctttaaaggagaagccgtggccctctcgtcactgtgcagccgccagcgccgcgcctgcgaccccgggcctgcggacaggccgcttcgggccccgccgcctccggatgcggcgctgagggcggtcgccatggagacggcagcggccgcggccccgggtccgggctgggcagcagagggggagcgccgacggcggcgctgctcgcgccgagaccgagaccgggagcagcggcgccgccgaggtccaggcggcgacgcgccccgggccctgttggccgccccgcgcggctcctcgtcctcgtcgtcgccgccgccgcccgccaggccttggtcgtcagcttcgtctggagagcggcctgggggcccgagacgccggcggccccgtccgagacctcgacccccgcgaccccgagctcggaagcggcctgccggctcgggcagccgcggggaggaagaggaggag

SEQ ID NO: 46722 - DNA, 2856 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 46723 - DNA, 1822 bp, Homo sapiens
ggaggactagaaactaactccgagcccttaaagggacggcctgctgttagaaggaccctggactccttaaaggggtggcctctttgagccggaggacttgagacacttttaaaggggaggtctgcgtttcggggcgagctttcggccccttttaaaggggtggcccttcctcttcctcggggagacttgcatcgacccctggcagggggtggccaccgcactaggccgccggacactgtcgggtcgtcttaaaggggccgggagctggacaacttggggcctcgccttaaagggacggccgccccgttttcgccgtcgcggccccgccgagcccgcagggggggccctcgggcttgtcgccccgggggcggcgccggctccccgggccgtggccttggggcaagctcggggccagcagatccggctttaaaggagaagccgtggcccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 46724 - DNA, 2281 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 46725 - DNA, 2237 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggt

SEQ ID NO: 46726 - DNA, 2168 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaagggggtcctggtaatattataacctttaaattaccagactttgcctttacc

SEQ ID NO: 46727 - DNA, 1075 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgagtctggccagccccctcgggcctgaggttccctgtctatagcctgaggcccagcttgtgcccactcagcctcatcagaatctcccacctctctgccccaggtgccgtcccgtgccccagccgccggcgcctgcggcacgggatgaccattctcttgttgtcttgtgactggggtcgaaactgcaggagaggctgcagaaccagtggagctctatggaagccgaggcttatagggggagctgcactcagggtcagcccatatcctggtccaggagtccctctcagcgtccaggctgtagcgccttacctcaagtgtcttgccccctggatt

SEQ ID NO: 46728 - DNA, 415 bp, Homo sapiens
cctgccttccggggccctatggggccctgccccctgggcaggagctctcccacccggcctccctcttcactgcgactggtgagtctggccagccccctcgggcctgaggttccctgtctatagcctgaggcccagcttgtgcccactcagcctcatcagaatctcccacctctctgccccaggtgccgtccacgctgcagccaaccctttcacggcagctcccggggcccacggacccttcctgagccccagcacccacattggtaagagccaagggcgtgttgggcaacccaggctttgtccctgacttccaggagatggaaatcagacccagcaggcagctggaatgcaggatagacctggttccacttgcttagtgaccttgggcaggttactctaccccctctgagccttg

SEQ ID NO: 46729 - DNA, 521 bp, Homo sapiens
aactaaggtgccagccatagaactgttcagcagtgatgggggacaggagagaatgtttctggccaagattctgctgagctctgttgagggccaatgcccagagctcagtcctcccctgactctgagacccactctccccagccctccggccccagtaccttcattttctcccagtgtctcaggcatgttgggggtgagtggatgctgtggagatgcgaggcgcctggcccaggactcgggtctgagtcgcctcccatctctcctttgccatccccagatccccgaccatttccggccacctttgagggtgagttgtgtgaggacctcaggctgcatgaggctgggggctggtgttagcatgtttggctaaggggggttttgcttacaaataagtgagaagcccagaacatggaggcagccagatgtggaacagcagagagtgagggctttcaagttgcagacctgggctcggatggaactggccatgggaccttgggcaaggcagttgatctctctgagcc

SEQ ID NO: 46730 - DNA, 2612 bp, Homo sapiens
aactaaggtgccagccatagaactgttcagcagtgatgggggacaggagagaatgtttctggccaagattctgctgagctctgttgagggccaatgcccagagctcagtcctcccctgactctgagacccactctccccagccctccggccccagtaccttcattttctcccagtgtctcaggcatgttgggggtgagtggatgctgtggagatgcgaggcgcctggcccaggactcgggtctgagtcgcctcccatctctcctttgccatccccagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 46731 - DNA, 1840 bp, Homo sapiens
  misc_feature (371)..(371): n is a, c, g, or t
  misc_feature (412)..(412): n is a, c, g, or t
cttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccncaggactcctgggccctgcttccctgaaccctgttctccanaaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagcaagaccccaccgggagcccttttgggggcaccacctccgcttgtgcccgccccccggcccagttccccacctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgaga

SEQ ID NO: 46732 - DNA, 1626 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccgtttctgggccctagcccaccagatcgctgtgctggcttcctggagccaacctggttggcagcacccccacgcctggcaaggccaccccgcttctatgaggcgggtgaggagctaactggacccggggccgtggccgctgcccgcctctacggtctggaacctgctcaccccttgctctacagccgcttggctcctccaccaccacctgctgcggccccgggaacccctcaccttctcagctgcactcatgaaaccccaataaatatcctcattgacaacc

SEQ ID NO: 46733 - DNA, 1462 bp, Homo sapiens
gaccacctgctgcggccccgggaacccctcaccttctcagcaagaccccacccctgctgcaggtgccagggcaccctggggcctcagccgctaacgccctttctgagcaggacctgatcggccaggacctgaactctcgctacctgaatgcccagggtggccctgaggtggtgggggcagggggctcggcccggcccctggccttccagttccaccagcacaaccaccagcaccagcacacccaccagcacacccaccagcacttcaccccttatcccccgggcctgctgccaccccacggcccccacatgtttgagaaatatccaggaaagatggaaggccttttccgacacaatccgtacacggccttccctcccgcagtgcccgggctgcctccgggcctcccgccggccgtctcctttggctccctgcagggggccttccagcccaagagcacgaaccctgagctgccaccacgactggggccggtgccgagcgggctctcccagaaggggacacagatccccgaccatttccggccacctttgaggaaaccagggaagtggtgtgccatgcacgtgcgtgtggcttacatgatcctgagacaccaggagaaaatgaagggtgactcccacaagcttgactttcggaatgacctcctgccctgccttccggggccctatggggccctgccccctgggcaggagctctcccacccggcctccctcttcactgcgactggtgccgtccacgctgcagccaaccctttcacggcagctcccggggcccacggacccttcctgagccccagcacccacattgatccctttgggcgtcccacaagcttcgcctctttggctgccctctccaacggggcctttggaggcctgggcagccccacattcaactccggcgccgtctttgcccagaaagaaagcccaggggccccaccagccttcgcctccccaccggacccatggggccgcctgcaccgcagtcctctgacctttcctgcctgggtccggccccctgaggccgcccggactccaggctcagacaaggagcggcctgtggagcggagggagccctccatcaccaaggaggagaaggacagggacctccccttctcacggccccagctccgagtttctcctgctactcccaaggcccgggctggtgaggaggggcctcggccaaccaaggaatctgtgcgggtaaaggaagagcggaaggaggaggctgccgccgccgctgccgctgctgctgccgccgccgctgccgccgccgcagcagccactgggccccagggccttcacctgctgtttgagaggccccggccgcccccaacctagaaggcaggggtcaatctaacaaaaccctaacgttgacttttttccctggtggggcttcttctgtaacatgacttgcgaatatttatataaaaacgagtgttacaatgaga

SEQ ID NO: 46734 - DNA, 384 bp, Homo sapiens
caccctactccttttttaggtatccgtgccctccaagattgcatggaaaatcaatttgtttcccccaaaagttaattgtctggataaagtatcgttaaggcctggggtgggttctccccactgcccaccccaacccacaggagctccagctagggtctgggggaggatggagcttgctctgtgacgtcgtggccccatcactgctgctgctgcctggcgtcagccacctctcctgctcctctctcttctcctctgctgtccacaatgagtaggagggaggtgcagtccccacctctcacccctcaggtctgtgttacttggtttttaagtgactgattgggatagaaccctaaagaaataaaacttccagtggatacgaaaaaa

SEQ ID NO: 46735 - DNA, 528 bp, Homo sapiens
ccctcagccttaaaccccgcctggtccccgtgacacgctgcgtgatggtggcttcctcggccctctccggggtgggcgtggggtggagtgccctggccagcctcccacctctgccttcattcctgccaccaccgtgcctctccgtcctcctcttccacttcctcctctccgtgtgcctcaggctcctgccagaagacattggttgagcccacaaggagactgtctggggaagggatggggagggcctggggtgggttctccccactgcccaccccaacccacaggagctccagctagggtctgggggaggatggagcttgctctgtgacgtcgtggccccatcactgctgctgctgcctggcgtcagccacctctcctgctcctctctcttctcctctgctgtccacaatgagtaggagggaggtgcagtccccacctctcacccctcaggtctgtgttacttggtttttaagtgactgattgggatagaaccctaaagaaataaaacttccagtggatacgaaaaaa

SEQ ID NO: 46736 - DNA, 486 bp, Homo sapiens
gaaaccctgtctctactaaaaatagaggaagggatgggcctagagattgaccatcaccccagatgttgatgaaaattacctcaagtcaagtttacagagtgagaaggggacctggagatgttttcccccgggcaacaccctctattaaagggatgggtttaccaaaggagagtgaagaaaatctggaggtgttgaaggaaaatcacaaggggctagtctcctcaaaacaaaggaggggagcacttggagagaaaggaagggttcacagtgcccaggtgccacagtggggtcgagcagtgtggaaacccagggagaaatcctgaggaaggctgtgtcctcacagacagcatccgtggccttggggaagagactctgagttccatgctttatgttcttgttaagttttaccagtttcataagtaggttgctgtcttttctaattctaaaaatagtgcacatttattgtagaaattttagaaaatacaa

SEQ ID NO: 46737 - DNA, 448 bp, Homo sapiens
atgatgcaactggaaggctccttaagtgggaggcaggagggtcaaaggtccaggagaaggaagcggctcagaatgcagtgatgcagtgaagagccagcctctagatgctggaaggcccaaggaacaggttctcccctggagcctacagaaggaaccagtcctcggaacaccttcatttcagcccagtaacactggatttgagactccccacctccagacctatcagggaatagatctgtgttactgtaaaccattaagttcatgttgattttttacagcagcaataggaaactaaaacacaggacttgtagtcatacaaagaagagttgaattaaatcggcagtgactttaccccacaaacccaggggcaccagggacatgtcagagaagagagaaaatgtgacagcgttcattaatgaagagttaaacctcaccaataaaatttaaa

SEQ ID NO: 46738 - DNA, 393 bp, Homo sapiens
ctttccagagtgtgcggacccaaagcttgccatcagtgctatctggaccttcagagacctaggggttctgcagcagacgccgagccctgcaggccccaggctccacctatcccctacttttgccagccaggacaatcaggaaaaactagaacagttcatccggcagttcatttgtagctagaactgtgaggaggagcctgtgctgagacttctcagccccagaacacagctgtgtcctagagccagaagatggagaggaggctgcaaacccttagctgctctataaatataatcattgaggcttgattgtcccttgccatctcttgctttttccctcctttgatgtgataaacaaggggacgagacgagttgtcttttccccagcccagcagc

SEQ ID NO: 46739 - DNA, 1194 bp, Homo sapiens
cttattaacagctccatcttctccattgtaatatttccttaaaaagaaaatttgcagacatggtctgaatgatttagagtgatgtgtaacagtttggacaggctggttgcacccctgaaagcctcctttgtcattgccagctaggatgtcatctgtttgaactggtctttttcgtgtttgcctagggtgagtagagagtggtgatttagtagagctgttggctgcttcctggctgctgtaggaagttagtttttctggctatatgtgtatgaggcgggaagcagattgttaggagtctttaatattctaattttacctctgagaaaactgggatgacttagagtgtagtaggtattgtggtttgtttttcccttcctttcctttaccaccccactcctcgccgccttctccttctctttgtcctcttacccatccctcccctttcctcctttgtctggattattagaagaggttgaattcagaaatgtgactaatttttacagattgtgtttttacagactagtttttagaaatgtgacagtttttacagattgactcccttcactgaagaaggaactttctttgtagtctagatttttttagttttatgatacatgtctagtgtagagaagttcagggaccataggactggaagagcttggtatacttacgtgctggtactgtttttttttatacttttctctatttttcttgtgccctaggtttttccttccagttgggttaaaaaaaaaaagttgttgaggaacattgatatggtgaaagagttgttttttatttccatatttatattaaaatagttttttgcatgtgtatgtttctctgagtggggagagatagtagtcttgtgtatgtgtcaggaaaatattataagatgtttccagaattcccagaaattaggactgttactagaattccccaagatgaattagcatgaaggctaatttgtcattaaaacattgatatccttcaaaattgaaaaaaaaatttagaagaaacatttaacaacataatcatttctgccatcaagtaaaaattaaaaagtacaacagtgttggccaggtgcagtggctcatacctgtaatcgcagcactttgggtggctgaggcaggtagattgcttgagctcactagtcagagacctgcctgggcaacatggcaaaaccccatctctgca

SEQ ID NO: 46740 - DNA, 1140 bp, Homo sapiens
cttattaacagctccatcttctccattgtaatatttccttaaaaagaaaatttgcagacatggtctgaatgatttagagtgatgtgtaacagtttggacaggctggttgcacccctgaaagcctcctttgtcattgccagctaggatgtcatctgtttgaactggtctttttcgtgtttgcctagggtgagtagagagtggtgatttagtagagctgttggctgcttcctggctgctgtaggaagttagtttttctggctatatgtgtatgaggcgggaagcagattgttaggagtctttaatattctaattttacctctgagttcctttaccaccccactcctcgccgccttctccttctctttgtcctcttacccatccctcccctttcctcctttgtctggattattagaagaggttgaattcagaaatgtgactaatttttacagattgtgtttttacagactagtttttagaaatgtgacagtttttacagattgactcccttcactgaagaaggaactttctttgtagtctagatttttttagttttatgatacatgtctagtgtagagaagttcagggaccataggactggaagagcttggtatacttacgtgctggtactgtttttttttatacttttctctatttttcttgtgccctaggtttttccttccagttgggttaaaaaaaaaaagttgttgaggaacattgatatggtgaaagagttgttttttatttccatatttatattaaaatagttttttgcatgtgtatgtttctctgagtggggagagatagtagtcttgtgtatgtgtcaggaaaatattataagatgtttccagaattcccagaaattaggactgttactagaattccccaagatgaattagcatgaaggctaatttgtcattaaaacattgatatccttcaaaattgaaaaaaaaatttagaagaaacatttaacaacataatcatttctgccatcaagtaaaaattaaaaagtacaacagtgttggccaggtgcagtggctcatacctgtaatcgcagcactttgggtggctgaggcaggtagattgcttgagctcactagtcagagacctgcctgggcaacatggcaaaaccccatctctgca

SEQ ID NO: 46741 - DNA, 926 bp, Homo sapiens
  misc_feature (925)..(925): n is a, c, g, or t
tgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctgttctaattgctaatccagtatttgcggatagctccaaactgggatattgttctcaggcgctgtggtctcaccttccactggggcaacaatgggccatttccagcagggacggcgcagtgttggcctgcatgcctgactgccacacacctccagaatcaggtgtctgaaaagtggcagtgacgaaagaagagactctcccggccgaggccccagtgcatggagagaaggaagaaatcaatttcctaattggtaccatatacatcagatggatggtttctagtgtgcttccaaaccccacctcggctgagtgttgggcagcacttctacatgatcctatgactcttgatatggacgcagtcctgtcagactttgttcggtccacgggggcagaacctggtctggccagagacctgctggaagcaatgttcacagcatctttaccgggagcagattccatctcaagaaaccacttcccttgctcatccataagaagcaactccccaacttgagattgtagcaatttagtcacatcttcagactccacttctaattccagttctcttccacgacatctgcagttaattcttccactgaagtcttggaccccacaaagtcatccatgagagttggaatccacttcttacaacctcctgttaatgtcgataatttgacctcctcccatgaatcatagatgttcttattgacttctagagttgtgaactgcctttccagaaggttttcaatgtactttgcccagatcnt

SEQ ID NO: 46742 - DNA, 838 bp, Homo sapiens
tgaaagaccaagattggaatgactttttgtaacaagtgtgctcgcagatcgactccagtgagaagagctcggggacctcctgagccaagtttaatctcctttgctatttgtgcatggtggctggtcaccaggaggtggccaccaggcttctcctttccccgctggtaggcctctgtgacatgacttatgcatttaaatgtatgtttttatagaggctcaaacaagtgctaaaatagcaatttgatttaactaccatgaaaaaactgatttatcatgattttaggtttatgcaaattatcgtctgcttaatccttaggtcttaaagtagatgagagtagatggtgattttgaactttctgttgttgttgtttgtaatacttagatttccattttatgttaacttgtaagattttaaaaaaatatataggctgaggcaggaaaatggcgtgaaccccaggggcgcggagcctgcagtgagctgagattgtgccactgcactccagcctgggcgacagcgagactccgtctcaaaaaaaaaaaaaaatatgtgaaattagcccaggcgcagtggctcatgcctgtaatcccagcactttgggaggctgaggcgggtggatcaccgtgttggccaggctggtctcgagctcctgacctcgtgatctacccacctcggcctccccaagtgctggggattacaggcgtgagctagcttgcctggccagggattaatttttcaaactgttgtgttgtcccagatatgctgtcatttaggaaaagccgtacaatttctatgaagtgggtcgtgacctattttctgtagtcatcacgttgggatatc

SEQ ID NO: 46743 - DNA, 287 bp, Homo sapiens
atgatataagcaagctatatcttatacacttatctatatctatgtaagatataccattacccttttcttttttaatacagggtcttgctctgtcacccagtctggagtacagtggctcgatcctagctcactgcaacctcaaacttctgggcccaagtaatcctgctacctcagcctcccaaagtgctgggattacaggcatgagccaccatgcccagcctcaatattttaaaagtttatattttacaaaaggctttcacatccatatgatttaatttgaggtagag

SEQ ID NO: 46744 - DNA, 415 bp, Homo sapiens
ccaaatgaaggccatatacagataaacacattaattgtcaaagaattgaaatcatatagaatacattttcttttaacagcagagttcagctagtagttaacactaaacatgaaaattttaaaaataataactaaaaagtgctaaaatttttggaaaacaagatagacacttctaattaacccattggccaaaaaataattcaagtacaaataagaatttttttgattcattttgagatactacatattgacacatgtggaaggcagttaaaacccaacttagagagaaatttataatatatttttaaaaatatgtattagaaaaataaaggctaaaaatcaattatataaacatttaatctaagaacctagggaaaaacaagtaaataaaacctaaaatatatagaaaaaaaaaa

SEQ ID NO: 46745 - DNA, 783 bp, Homo sapiens
caaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaataatacctgtgtggaatataggctgtgctttgatttactggtatttaccccaaaataggctgtgtatgggggctgacttaaagatcccttggaaagactcaaaactaccttcactagtaggactcctaagcgctgacctatttttaaatgacacaaattcatgaaactaatgttacaaattcatgcagtttgcactcttagtcatcttcccctagcacaccaatagaatgttagacaaagccagcactgtttt

SEQ ID NO: 46746 - DNA, 711 bp, Homo sapiens
caaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaaatattaaaaaaaaaaaaaaaaaaaaaaaaaaaaagaaaaaaaaaaaaaaaaaaaaaaaaaaaaaacatgatgaccgcttgggccaaaacaactttaaattcaagcaagtttatgcatggggccgaaattcgagctaattgggccaattggccctaaagggagccgtattacaattaactgg

SEQ ID NO: 46747 - DNA, 719 bp, Homo sapiens
ggctatttaaaatttagttcctcagtcataataaccacattttgactgctcagtagtcacatgtggtatgtgtctactgtattagacagtgcagaggtataccatttccatcattagagaaagttctgctgtacagctttgcatgttgagactcttatttgctctgtgataaagaaaatggaattttctttcatctttttgctcagatctgccgtgtgtggggctaaaagacatggattagatggattccttttcaagttttttttccaactcagtttttgggtgaccttcatctaatacctagacaaattgaaaagtgaaatttgccatctatcattggttggatcaaatcacacaatcataattaataaatcggacagatttgctttttttttaacgacaaattctttttggccaatgaaccactggcctttatttctaaaaagtgcagttattccagggaggcccctgacatgtctaaaattgaaatcatagtaaagaaagtaaattgctgggcatggtgatgcatgcctataattctagcactttggaagtataaagcaggaggattttttgaggccaaaagttcaagaccagcctgcgcaacatggtgagaaccctgtctctacaaaaaaattttaaaaattagctgggcgtgacagctaataatctgaactacttggaagtctgtaatctataatctataatctgaactactt

SEQ ID NO: 46748 - DNA, 255 bp, Homo sapiens
tgcacatttcacttcttgtttactagtttgtttctccatgaacatatggagaagtaaccatatgtaggtggttttagaattcactgtcgttgcaaccgattttataggaatgaaaacgttgcagaatgtgttcaacttgtatcaccttgaaagtcaaattcccatttctggaggtccaaaacacttgaatgttggcaattttatatggttctatgcaatcatgtattaatcacactcttccttatagcatatatt

SEQ ID NO: 46749 - DNA, 455 bp, Homo sapiens
caaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctagaaatcaaggtcctgaggcgattaa

SEQ ID NO: 46750 - DNA, 575 bp, Homo sapiens
aaaaaattcaacaagctctaataggaactaatacatatttttgaattatttgatgatgattggtaataattacagatacttctcaacttatgatgggctgacttcatgataaaccctttgtaagttgaaaatatcttaagttaaaggtgcacttaataccccaatgaacctattgtaaagtcaaaaaaaatggtaataccatcataaattggagaatatctgtactaaatggttttatagtataaaatgttcaacctaactctagttaataagtatatgaacaggccacttactagttggatgaaatatattacaaataaaaaatcataatgcatgtccttatgccatatgttgcatgacattttaaaaaatattaaatacgtcagtgtgggctaatattttatttgtacaattttttaattttataaatctcttctgctaatcttactttgtaaattaatttttaacctattttaaatgctagtcatttccaaaaatttcatttccatattttattcctataaaacttcatccagttagtaattttctatttattgctaatttatttcctgatg

SEQ ID NO: 46751 - DNA, 364 bp, Homo sapiens
aggcacaggttgcagtgagccaagatggtgccactacactccagcttgggtgacagagcgagactccgtctcaaaataaataaataaataaataaataaataaataaataaataaataaatataaagcaaaagaccccaatctcaaccctgtatctctccaactatccctgctcctctttcgagttaatatttttaaaacttttattttgaaataattacagccttacaggaagttacaaaactgtgcagagaggtcctgggtacctttcacccagcttttcctaatgataacatcttatattactgcagcataatagcaaaaccagaaaatggacattggatacaatctacagaccttattaa

SEQ ID NO: 46752 - DNA, 276 bp, Homo sapiens
ttgtatacaatttcagttatacaagatgagtaagtaagtcctagagatctgctgcacattttgcttatacttaacaatactatactgtatatttagagatttgttaagataatagatctcacgttacatgttcttaccacaataaaaatattaaaagcaaagtaaaaagttggtgttggcaagtcaggtttggtccatggagccttatttgctaatcttttgtctagattatcctgactgatacagtctcataatgaagtcatgggaaatacatga

SEQ ID NO: 46753 - DNA, 2260 bp, Homo sapiens
attttcgaagttttcacagttctgcaagtttccaacttgtgtgtaaataggtagaaagaggtagggaaggatacggcgcccgtccaccccttaaggagtgagaggggatcaggccgagcgagcactgacctttgacgtcctttgttgtgaggaaagtccatctatgtgttagttatggaattaaacactaatacaaacaaattatcataaaaatgaaacaaaaacaaaaccccagctgtttatagactccccttcccagatgtatagctgggagaggtccgtctcacactggcttccccctctctctggcccacactcctgtcaccatctccattgcacccatagtggaaatagctaggaagtgaaaacagctagggaagaagaaagagaaacaaaaacaaaaagaagcaataatatccaagacaagccctccccacatctaaattacaaaattgttataagtaaactaaaaagcacattttctttagccaggtagaaaaattaatatgtccaactgtgaaaaaacttcttttgatttgatagaatagacagccatggtgttgtttttcaaaaaatatgggcagcagtagttccaaataggaatacaaagaattagtatggtggttccctcaagtaaggtatctttcttttaaaaagtgagatttgttcagggttagggttttgctgattttttttctctccctgtgaaaactgggttatagatcattataaaggaagcccatattttctgatacttttcagagacatttctcatttgaaatctacaacagctctgtgatgtcttcagagatttcattttttaacacacatcattaggattgtagcaataaggtcatacagaccttatccaagctcttctgacaccattagacaatacagtttgagaaggagaaaatgaactcatttaaaaattaattgtaatctgacaattttgaaattcctttgctgaagaaaaatatggaagttttgaggttcagggttgggaggcaagagaggtacctgttagtgtggtttgtccccttcctagcacatgtagcctcaagtttgaattcctgggagaagaaaagtctttacatctgtgatgtgggaggttgttcccagggaacatcatgtttttgtgggcaaatacaagttgttataattaaaacccctaatttgaatatttttgttaccaagaaccaaggcaaatgtttaatttgttataaaacctgtttgtgaagtgctgtgttaaattgtgctgctggctaataggcctcatttcaatttaataaatatttattgaggactggctttatgtctggccctgtgctatgccctgggactcaaaatttaaaaaattacgagccctgctctcaactgttctcaagttgctctcagttctatgaggaaaacattcagtcattcagttgtttatgaggaaacactaattaattaagtacctattaagtattgggcattctttggcaatttgtggttgaaagacattcctgccttcaatgtactatagtctcatatatgtattttaagccacaaataataaccaatgagtaggccttgaaatcaatttagtggagcaaaacagcactttgggaggctgaggcgggtggatcattagatcaagagatcaagactatcctggccaacatggtgaaaccctgtctctagtaaaaatacaaaaattactgggtgtggtttcacacgcctgtagtcccagctacttgggaggctgaggcaggaggaatcgctttaacctgggaggcagagggttgcagtgaggctgaggtcgcgccactgtagtccaacctggcgatagagtgagtgagactccatctcaaaaacaaaaaaatggaatagaataggatatatctaaattcatctcatgtagtaaggttgttcattttgtgaaactttaaaaaaaaaatttaccattcttccttttttgattcattctttgattactatcatgcacactgccatgtttcttttccttttgtttttatcaagagtaataactatccaacctgatcaacatggtgaaaccctgtctctactgaaaatataaaaattagccgggcgtggtggcgcgtgcctgtaatcccagctactcaggaggctgaggcaggagctactcaggaggctgaggcaggagaatcacttgaacctaggaggcagaggttgcagtgagccaagatcacgccattgcactccagcctgggcaacaaagtgagattctatctca

SEQ ID NO: 46754 - DNA, 632 bp, Homo sapiens
gtatagattgatttagattttcttttcttttctttattttttttttaagagggagtcttgttccgttgcccaggctggagtgtggtggcacgatcttggctcactgcaacctccgccagctgaggcaggaggaatcgctttaacctgggaggcagagggttgcagtgaggctgaggtcgcgccactgtagtccaacctggcgatagagtgagtgagactccatctcaaaaacaaaaaaatggaatagaataggatatatctaaattcatctcatgtagtaaggttgttcattttgtgaaactttaaaaaaaaaatttaccattcttccttttttgattcattctttgattactatcatgcacactgccatgtttcttttccttttgtttttatcaagagtaataactatccaacctgatcaacatggtgaaaccctgtctctactgaaaatataaaaattagccgggcgtggtggcgcgtgcctgtaatcccagctactcaggaggctgaggcaggagctactcaggaggctgaggcaggagaatcacttgaacctaggaggcagaggttgcagtgagccaagatcacgccattgcactccagcctgggcaacaaagtgagattctatctca

SEQ ID NO: 46755 - DNA, 370 bp, Homo sapiens
tgatccacccgcctcagcctcccaaagtggcgggattacaggcgtgaggtcctcagctttaattatgccactttcttcatcagaagtagtccctggacaaaaaagaagagtccacagttttgaccatgcaggtgtgccaagggacatgaccaccacgcatctgtgtggctgtctccaatgtgatcatttcagcaaccagagctgagcacagcatccacccaggaatggctccttcaaccttctaatgcccggcactaaggctcaagatggtaatcttattacctgcttaaacaaatccccatttaaaccaccaagaggtttagctttctgtcttgacaagtcaccagagcgtgcttgcatactctaagga

SEQ ID NO: 46756 - DNA, 242 bp, Homo sapiens
tgttgctgttgcttttgagcctccaaagaccaagatccacttaatagaccgtggcatttttgcctcatctactgacttaagaacttaatccatgaccctgtcactacaccccctgcacccccacccacgcacatttacatgctcactcgtacactcattcacactcacctctacctttagatttaacccactgagctgtactgagccagatgaactggactgttgattcttaccatttctgg

SEQ ID NO: 46757 - DNA, 385 bp, Homo sapiens
tttaagggaaggaacatacttttctccatttccttcatcttgcaggcgggaatgcagagttaatacctagaagttaagtagccctcatagctcaatatgtgaccttggggattgtattattttatttatttttaaaatttttttaaggaggtaaggtcttgctttgttgcccaggttggactcgaactcctgggttcaagcaatcctcccacctcaacctccccacgtagctgggactacaggtgcatgccaccacacccagtggggattgtattagttatctgttgctgcataagaaattactccacaatttagtagcttaaaacaacaaacattatcttgctgtttctgtggtcaggaatttaggaatggcttagctgggtgg

SEQ ID NO: 46758 - DNA, 518 bp, Homo sapiens
tctgaaaaatacggaagggttcatttacagctgttaaagatgggccggttttagggctaaagcaagactctggtcagatgttaacaactcagttatcctggggaaaaaataactggctcccaaccctttcccttttcagcatttgcaggaaaagaaggagtaggtaaaatgctttatttcctctcattctccatggtgggcaggagttcacataacaattataaaccatctttaacaggaaagccaagtaaatcctgtagggatttatttggagctccctttttgctagaaaatgagtatcatgaactaaaaatggactcgtttcctctctctccatcttcctctctttcttctctcccctcatctcccacccaccgccatggtggaaaatgactgtggtcaagaagattgaacatttgagcaagaccagatgcctttatatccaatagatgccacggagagtagatcacaacacatctaactgctgtatccccatataaaataattttaattttcct

SEQ ID NO: 46759 - DNA, 2815 bp, Homo sapiens
  misc_feature (1)..(1): n is a, c, g, or t
  misc_feature (3)..(4): n is a, c, g, or t
ngnncagcggcagagtagaggccaagggagggctctgtgccagccccgatgaggacgctgctgaccatcttgactgtgggatccctggctgctcacgcccctgaggacccctcggatctgctccagcacgtgaaattccagtccagcaactttgaaaacatcctgacgtgggacagcgggccagagggcaccccagacacggtctacagcatcgagtataagacgtacggagagagggactgggtggcaaagaagggctgtcagcggatcacccggaagtcctgcaacctgacggtggagacgggcaacctcacggagctctactatgccagggtcaccgctgtcagtgcgggaggccggtcagccaccaagatgactgacaggttcagctctctgcagcacactaccctcaagccacctgatgtgacctgtatctccaaagtgagatcgattcagatgattgttcatcctacccccacgccaatccgtgcaggcgatggccaccggctaaccctggaagacatcttccatgacctgttctaccacttagagctccaggtcaaccgcacctaccaaatgcaccttggagggaagcagagagaatatgagttcttcggcctgacccctgacacagagttccttggcaccatcatgatttgcgttcccacctgggccaaggagagtgccccctacatgtgccgagtgaagacactgccagaccggacatggacctactccttctccggagccttcctgttctccatgggcttcctcgtcgcagtactctgctacctgagctacagatatgtcaccaagccgcctgcacctcccaactccctgaacgtccagcgagtcctgactttccagccgctgcgcttcatccaggagcacgtcctgatccctgtctttgacctcagcggccccagcagtctggcccagcctgtccagtactcccagatcagggtgtctggacccagggagcccgcaggagctccacagcggcatagcctgtccgagatcacctacttagggcagccagacatctccatcctccagccctccaacgtgccacctccccagatcctctccccactgtcctatgccccaaacgctgcccctgaggtcgggcccccatcctatgcacctcaggtgacccccgaagctcaattcccattctacgccccacaggccatctctaaggtccagccttcctcctatgcccctcaagccactccggacagctggcctccctcctatggggtatgcatggaaggttctggcaaagactcccccactgggacactttctagtcctaaacaccttaggcctaaaggtcagcttcagaaagagccaccagctggaagctgcatgttaggtggcctttctctgcaggaggtgacctccttggctatggaggaatcccaagaagcaaaatcattgcaccagcccctggggatttgcacagacagaacatctgacccaaatgtgctacacagtggggaggaagggacaccacagtacctaaagggccagctccccctcctctcctcagtccagatcgagggccaccccatgtccctccctttgcaacctccttccggtccatgttccccctcggaccaaggtccaagtccctggggcctgctggagtcccttgtgtgtcccaaggatgaagccaagagcccagcccctgagacctcagacctggagcagcccacagaactggattctcttttcagaggcctggccctgactgtgcagtgggagtcctgaggggaatgggaaaggcttggtgcttcctccctgtccctacccagtgtcacatccttggctgtcaatcccatgcctgcccatgccacacactctgcgatctggcctcagacgggtgcccttgagagaagcagagggagtggcatgcagggcccctgccatgggtgcgctcctcaccggaacaaagcagcatgataaggactgcagcgggggagctctggggagcagcttgtgtagacaagcgcgtgctcgctgagccctgcaaggcagaaatgacagtgcaaggaggaaatgcagggaaactcccgaggtccagagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctatttaaaaaaat

SEQ ID NO: 46760 - DNA, 869 bp, Homo sapiens
  misc_feature (1)..(1): n is a, c, g, or t
  misc_feature (3)..(4): n is a, c, g, or t
ngnncagcggcagagtagaggccaagggagggctctgtgccagccccgatgaggacgctgctgaccatcttgactgtgggatccctggctgctcacgcccctgaggacccctcggatctgctccagcacgtgaaattccaagccccacctcctaacaccatggattcaaagtgctcagggaatttgcctctccttgccccattcctggccagtttcacaatctagctcgacagagcatgaggcccctgcctcttctgtcattgttcaaaggtgggaagagagcctggaaaagaaccaggcctggaaaagaaccagaaggaggctgggcagaaccagaacaacctgcacttctgccaaggccagggccagcaggacggcaggactctagggaggggtgtggcctgcagctcattcccagccagggcaactgcctgacgttgcacgatttcagcttcattcctctgatagaacaaagcgaaatgcaggtccaccagggagggagacacacaagccttttctgcaggcaggagtttcagaccctatcctgagaatggggtttgaaaggaaggtgagggctgtggcccctggacgggtacaataacacactgtactgatgtcacaactttgcaagctctgccttgggttcagcccatctgggctcaaattccagcctcaccactcacaagctgtgtgacttcaaacaaatgaaatcagtgcccagaacctcggtttcctcatctgtaatgtggggatcataacacctacctcatggagttgtggtgaagatgaaatgaagtcatgtctttaaagtgcttaatagtgcctggtacatgggcagtgcccaataaacggtagctatttaaaaaaat

SEQ ID NO: 46761 - DNA, 719 bp, Homo sapiens
cgaggggaaataacccacccagagccaagtaatatctctttgcagagccagtaccgcactaagtctccactgttaagggtgtggtggtggggatgggggcgtagccagcagaggtacgtgtcagagaaagagaaagcttgaggcttgaatgtccaccatttattctttcattcaacaaaattttttgagaccttactttgtgccaggcctttactttgcagtggttagtaggaattcgatggtggaaatacaccaagaacaagacagacatggtgtcagacatactggaactcacagctttgttggaaaagagagacaggaagcaaataattacctatgaaatatataattatgatttttttgtgttgagtgctgacaaatagggcagtgccattagagtttgtaattttgtcagtgatgtttaaggtgagaagagtttgggcgcggtggttcacgcctgtaatcccagcactttgggaggccgaggtgggcagatcacgaggtcaggagttcgagaccatcctggccaacatggtgaaaccccatctctactaaaaatacaaatattagctgggtgtggtggcgggcgcctgtaatcccagctactcgggaggctgaggccggagaatcatttgaacccgggaggcagaggttgcagtgagccaagatcacgctattgcactccaacctggatgagagtgcgagactatgtctcaaaa

SEQ ID NO: 46762 - DNA, 331 bp, Homo sapiens
attaggtgcagcagcagcagtggcagcatatttgttgcaactgatcagccactaatggtttaaaaacttagaaattgggggcttcttttgtcaattgaagaggattattccaagccactgaagctccttgtcagaatggaaaagtgtattaaaagagataagattgcacaccccagggtcgcttacaatatgtaatttcctaagcacacatgcttaaaagaaaaatagatcaaatggatgagattggagatccctaaaatagtctcctgtccagatcaaacataccaccaaataaacaaataaacaaacaaaatagcctgaattctgtttc

SEQ ID NO: 46763 - DNA, 729 bp, Homo sapiens
tggcgtggaccaaaactctagagaaaggcttccttcctcagcacttagacatggccagacctggggcaggccgagtgtcaggcccggtactcaggagacaatgaggcttgctgcagcgtttctaatggcagctctatatttctagggagttgttttatttgtttttttaatgtcacaattttgtttctatgtattaaatattgaactttcttttactctagttagaaaaaatcagagtagaaatcccaaaattacagtcatgcaccatataataacatttcagtgaaaaagggaactggcatatatgatggtggtccccataagattacaatggagctgaaaaatttctattacctagtgatgcattgatgattctgaccctgagtaggcctagactagtgtgtgtgtttttgtcttactttctaacaaaaagttttaaaaagtaaaagacacctgtaatcccagcaatttgggatgccaagaagggaggattgcttgagcttaggagttcgataccagcctgggcaacacagggagaccctttctctaccaaataataacaataataataagttaaaaaataaaaaaaaattagccagttgttgtagcacatacttttagtcctatctactcaggagccagaggaggatcacttaagccaaggagtttgaggtgggagtgagccatgatcacaccactgcactctatcctgggcagcaaagtgaagcc

SEQ ID NO: 46764 - DNA, 870 bp, Homo sapiens
aatctttccactataactcagctgaactcacatctcccgtcaacatgtcctacaactgctgctctggaaacttctcctcccgctcctgtggtgactacctgcgctacccagcatcctcacgtggcttttcctaccccagcaatctggtctacagcactgacctctgctctcccagcacctgccagctgggttcctctctctataggggctgtcaggagatctgctgggagcccaccagctgccagacgtcctatgtggagtccaagcccctgccaagacctcctgctaccgccccagaacctccttgctctgcagtccttgcaagacgacttactctgggtctctaggctttggatccagcagctgccgctccctgggctatggatcgaggaagctgctactcagtgggctgtgggtccagtggtgtcagatccctgggttatggaagctgtggcttcccttccctcggctatggatctggattctgccgcccaacctacttggcttctaggagctgccagtctccttgttacagaccagcctatggatcaaccttctgcagatcaacttgctgaatttccagaccttttaagcaaagtgtctcagtctctacgtagagctgttatcataggcatttccagcaatgtgagctaacccctcttactactagctcttcatcctttctctggcatcaagtactggctggacaggctagttctttcagactgtgaaattaatgaatgagcaaaatatagagtcaaatgtctataattttgaaacaagtgattcgttatcacgtaagttcatcttataaagtatatggaagttcagttttgtttcacgtaataaattcatttactgttgattcca

SEQ ID NO: 46765 - DNA, 209 bp, Homo sapiens
aacttgctggaggtttctctctttagcctttgccagaccagtcaaggaaactgtgagttctcactgcaaaagctgcaaggctagggcagcttactgagcagaggccatagaaaagaccaggttttttcgattttatttcctaaaaataacatttgtcatgggatctttttctgactataaaaataatacatgtttattgaagaaatgca

SEQ ID NO: 46766 - DNA, 299 bp, Homo sapiens
atcctggtatagaaagtgcttttgaaagtgcctgtgatttggaatgctgaataccttttcaaagactcttttaatctgtataaagatgtagaatatatataaaatacagtgctctacactcaccaggtacctcatcaacgtggcttactagaaagctgtgtaggaggttgtaataagggtttttaacatttattcaaaattttacaaagcatgaaggcaatttttcaaaaaacacaaataattcagataatgacgagcttgttccttttcactgcagaaattttaggcaagatgacatt

SEQ ID NO: 46767 - DNA, 298 bp, Homo sapiens
taaatattatatttatgtgggactgtattctctccaccccgaccaccaagaaattaggttggctttgtgttttctattttagacttctggaggagaaggagcagggagaataaagaggaagcagaagggctagagggatataatgtcaagaggagagtattggttctagactgattatgatatagctcctggagagcccttgtgtgccttattctgactgtctttaatcctagctctgcctccatttatttggggctttctccatgttccaaccaggtacagttaccatatttgccta

SEQ ID NO: 46768 - DNA, 238 bp, Homo sapiens
catgccatgcaatgctgggggtgtttaaataccaaatttatgcatattttcaaggaagaagcagaagggctagagggatataatgtcaagaggagagtattggttctagactgattatgatatagctcctggagagcccttgtgtgccttattctgactgtctttaatcctagctctgcctccatttatttggggctttctccatgttccaaccaggtacagttaccatatttgccta

SEQ ID NO: 46769 - DNA, 519 bp, Homo sapiens
tttgtttctttcactgaaaactgttgctgtgatcagtcaaaccatcatctttcccagtttcgatgtttctttctcgattccgtttgctcagggtcctctttcaagctccttcaagttgttggcagaatttagttgctgtggttttaggaccgaggttcccactttcttgctgatcaccagcctggggcagctctcagccccttgaggccacctgcagttcctcatcctttggcagatcctctcacaacgtgggccacttacttcaagaccagcaagagaatgttcctcttcaggaagggcccaactcctccttatgggatgttcttctgattcagtcaggcccacccaaaataattgccatttttgggttaactcaaaaatcaactggatttgaggatccttaatttacatcaggcaaaatccctccaccttctccatacataataacctaatcatgggagtgactgttcatcctgttcgtgattaggctcacatataagagaaggagatcatatagga

SEQ ID NO: 46770 - DNA, 766 bp, Homo sapiens
gcaatttgaaaacaataaatctgcagtgagaagtagaattcatcatactaaatatcattttcctaaattcctcatttcaattctgttaaaaaggcctcttattattcgaattaaaattgtcaaaataccgcttcaaaagtagagcagagaaagagagacaagcatcatccagttttatctttcaatctttttgaagctctatatttacctaatcactctcgtgagaagggggttgctttgcaaaaagctttctttggagaaatgcattaaatccttcaagcaatcagggctatttttgtctttctatattagacacaccccaacaagtatggcagtctgctgacatcttcatcagcctgtttcttgcctcttggttatggcagcagagggtgaagcatgttcttctgcacccctgaccagcccaagcatcttttaaagtttctaattaaatcatggctgcttatgcccttggatatttgtcatttgcaagggaaaccatggggctgatgtttgtgtaggtattccatatgtattttgaaatttgggttttttattaacacttgagattaaaataattttaatccagacatctacctaacctgtggaaataatgcatgctctcccttcttctggactcaactataactaaccagcctgactggcttaagataaccttttctctttctccttcttttactcttctccctttcaaaaatagaccaatatgtgacacaaccgttctcattctcatgttttctatattttt

SEQ ID NO: 46771 - DNA, 350 bp, Homo sapiens
gtctctccgtctttcccttttatgtcttccatcacagggagttctgcatctccgttgcagaacaaccctgtagacttttagggttttgagttcccagaggagcatctcaaagcctttccaaatccaatgatgtcagaccttaaagatcacggggcccagggctggcaaatccatggcctcactttgctgcccacctttccgggtctgtcatggaaactgagaacagggcacatccctgtctggagtcttggaatctctacatcattgcaggtgatacccctaggaaactggaacttaagatacaatttatctgcctttcctaatttactctgaaagcaaaagttctagat

SEQ ID NO: 46772 - DNA, 569 bp, Homo sapiens
ggccagttctgcacatgaagagggatgttgactgctgtggtacacacagttcagaaggtcttgccccttgctgaccttccctttatacctgctgtggcttctacccttagccacttgctcctttgttatttctggcctttccttgaatgcatccttcattgcatcagggattaaagtggtacacgagggcctggccttatagacactcccaaggactctggtagggtcatgcagatctagtggaaacagcccggtgagtttgagagagtgaggagtggtagggactgtggagaagtagcgtgtgcacctgtacctcctgacattcaagttcaaattatttaatggcagccactctgctggccagtctaagcctaatgctaaccagatgtcagcatgcttttggctcactgcccctgactaagggaaaaacagcataaaggagcaggaacagtaaccacctgacctgagcagcattgcttgggtttttttctcacacttgatgtttcagtgccatcagctccttttgggtgactgtgtggctctccacctggcaatggtgaggagtggtg

SEQ ID NO: 46773 - DNA, 232 bp, Homo sapiens
gtgatttggagtcacccaagcagggatgagttaatgcaaatagagagattggaagagtacctgggccacagcattcacgaagtgtttgctattattattacgatccatttttaaattttcttctttatatctctaggttttaaaaatagtaaaggttttatttttaaaaaataagcacttctgggctgggtgtggtggctcatgcctgtaatcccagcactttgggaggccg

SEQ ID NO: 46774 - DNA, 377 bp, Homo sapiens
agaacaaacccagaggcattgcattattcaacctgaaactctactataaggctgccataaccaaaacagcatggtactgatacaaaatcagacacatagaccagtggaacagaacctggaatccagaaataaagtctcacatctacagctatctgaccttcgacaaatttgaccaaagtaagcaatgagaaaaggatttgctgttcagtaaataatgctgggatagctggctagccatatgcatgaaatcaaattggatccctccttttcaccatatataaaaaattaactcaagatggattaaagatttaagtgtaagtcctcaaagtgttaagaatcctagaaggaaacctaagagacaccattctgaccataag

SEQ ID NO: 46775 - DNA, 537 bp, Homo sapiens
gggaggacaccgtagcttatctttctttcattagctctagaagtgtttcacctttccatgtgcattttaagttgctaaggaagcaagttggattgtcaggaaactgcaagtttgatgtgagaagtcaggcccattcccattctgaccctctatagagcgcgatgtgatgattgatagccaagctgaccagagaactttagagcttaaagaattttataagcaataacaaccattatcattatcatcattatttatttatttattttttgccagacagtctgagtatgtttatatcatcattatttttgatgctacctgtcaggtagctttccaaagtgataatatttttattataaaatatttaaatatcatattgataaattgaatgtttccttgaccatcccatggccagtctcaatctttgtcccactggtaaccattgttaccaatgggattaaggatatacactaaactggtaacagtttaccggttaaaggatatacactaaactggtagcagtttaccagttaaactgct

SEQ ID NO: 46776 - DNA, 155 bp, Homo sapiens
aatcaacagtgaggtaaacacttcttgggaccatctggcaagcattttaatccaaaatattctgtaaacactgactccatttgagtacccaggaactaccgtccagccgccatcaactgcatttttatttcagttttaagcagtaattgaaatag

SEQ ID NO: 46777 - DNA, 383 bp, Homo sapiens
atgacttcaaagccttccatttttaatatagaatggtattatatcacaaatatgtgcaccatgacacatttgaaaggagccatacaaaagaaacacaatatatgaaaataaaaacatgtaagaagcagatttatgcagccttactaaaaatttgatgtggttaccataaagttgaatgatggtcaatggctactatcgcttaccccatatcatggaaatcctaacagggagagtgattctttacattagatggtaaataattaagtctgatgttcaaaatacacacagtcagaaaaaagaaatgtctctttctctggataataaacgacattgtctgccgaaatcctagaggtgaatgccaagaactagatgagtcagaaaaa

SEQ ID NO: 46778 - DNA, 570 bp, Homo sapiens
tgctgggattacaggtgtgagccaccgtgcccggctggcagcactaactttaaaaaaatgtttttgtttgcttggtaattcatggttgtaacaaaccaacagtatagaaaaatataagtgaaagcccctgtcttagtccactcctggtgctataacaaaataccttagactgggtaatttataaacagcagaaactttttcccacagttcttgaagctgggaagtcggggatcaaagctgtagccttgattcagtgtctggtgagggcctgctctctacttcaaagatggcatcagcaccctcttcctgcatcctcacacagagctccatccagcctcttttagaagggcactaattccattcataagggtggagccttcataacttaatcaccccctaaaggcttcccctcttattacccgtacattgtgggttagatttcaacatatgaatttaggggggatcaccacagttcagaccatagcagcccctaacattaacttttatttaaaataatattttattataaatgtaatctgtgttcatggtttaaaaaaaaaacaaactttg

SEQ ID NO: 46779 - DNA, 312 bp, Homo sapiens
aggtaacttaggcttgctaacataacagttaagagccactgactaaggacagatgggatttagccagacagtgactagacagggcaaacgtgaggctgggggtggctaaaaactaccaagaaggaaaccaagtccccctccctcccagtggcttatgggtggcaaggcctccctgaaatccactgccccacccccctccaggaggccctgttcacagtgcgtgagcagaacagtgactgctgagggcagagagagacgtcaggaaagaccccgggctgtggggacctccccacacctgcctgggagctctgt

SEQ ID NO: 46780 - DNA, 3883 bp, Homo sapiens
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgta

SEQ ID NO: 46781 - DNA, 4017 bp, Homo sapiens
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctctgtgtacaacttttaaaatctgactttgttttaaaaaaacataaactgttcattacattcttcatttttatcatttatagttttatgcatgtaataaactaatatgtcataagatga

SEQ ID NO: 46782 - DNA, 3660 bp, Homo sapiens
  misc_feature (29)..(29): n is a, c, g, or t
  misc_feature (42)..(42): n is a, c, g, or t
  misc_feature (56)..(56): n is a, c, g, or t
  misc_feature (62)..(62): n is a, c, g, or t
tcttgtatgatttttgttgcccactgatncttttggtagagncaatactgcctatncattcngtaggggccttgtattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctctgtgtacaacttttaaaatctgactttgttttaaaaaaacataaactgttcattacattcttcatttttatcatttatagttttatgcatgtaataaactaatatgtcataagatga

SEQ ID NO: 46783 - DNA, 3867 bp, Homo sapiens
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagaagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctctgtgtacaacttttaaaatctgactttgttttaaaaaaacataaactgttcattacattcttcatttttatcatttatagttttatgcatgtaataaactaatatgtcataagatga

SEQ ID NO: 46784 - DNA, 4168 bp, Homo sapiens
gcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccacattagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctctgtgtacaacttttaaaatctgactttgttttaaaaaaacataaactgttcattacattcttcatttttatcatttatagttttatgcatgtaataaactaatatgtcataagatgaaaaaaaaaagaaatttgggcttcttgggcttaagggtggaacttttggggcggtttcctttagggagggtaattttatgatcctcggtcatttgacttgttgggctggggccttccgttgggggaaaccggtttaacctatttataggggg

SEQ ID NO: 46785 - DNA, 300 bp, Homo sapiens
cacgcctgtggtccccgctatttgagaggctgaggtagaaggatcacttaagcccagaagattgagactgtagtgagccataatcacaccactgcactcaaccctgggcaacagagtgatatcttgtaggagggagggggaaagaatcacctcggagagcaagttttaaatggcgatttccaggcaccatcccaagagcttctacttcaagtggtctggagtgagagcctagaatctgcatttttaataagcatcttcaaccctggtgattctgatgaactggggcatatactgcacttg

SEQ ID NO: 46786 - DNA, 466 bp, Homo sapiens
tctcagcaaaccctcacccgtgtctttatcttcttctgtcagtccctctcctcatgctacctccctattccctgacacccaccttccttgcatctgttttccctgccgtcagcaagagattccaagtagatttggcaaggtcttcctgatctctacggtcagacattgtgtctatgtgcacgcacacagacataccgtgccatatcagtatagggaagcaggctaggatgaaggaaacatgggagaggggaagcactttgggaggccaaggtggaaggattgcttgagcccaggagtttgagatcagcctgagaaacacggtgaaaacccatctccactaaaaatgcagaaattagctaggcataatggcacacatctgtggtcccagctactcaggaggctgaggtgggaggatcacttgaacctgaaaggtcacggctgcagtgagccatgattgtgccaccgc

SEQ ID NO: 46787 - DNA, 305 bp, Homo sapiens
ttggcattttggaaataatcagaaaattaaaaaatgcacacaccactttcccattcttctccccaccccaacccctacccctatcctcaaatgcttagctagtgaaatattaaaatgttgtaatagaaattggagtcaaggtctccttgctgaagagaccatctattttcagagactggaaggagagagaacaaaccaatcaagagtcattggtttgttgcctctattgttttatttctgacctgcgcaaatagcttttgaagtggagatatgctagttcttggcaactaatacttttctgggca

SEQ ID NO: 46788 - DNA, 583 bp, Homo sapiens
gggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagcagcctacctcctaccccagctgtctgttgagagcagtgctgaccccagcagttagggactggctgcatagcatacttgttgggggtaaaacttgttgcttttatgtgtgcttgaaaacatttttcaaagttacacaacagaaatgcaatcatattgtttatttttaagtgttctataatgttaaataaaactttgatcatctgca

SEQ ID NO: 46789 - DNA, 478 bp, Homo sapiens
gccgagcagatgatggtgccgtgcttgtacaggctgcagaactgagagccaaagtaacccctgttttctttgtaaatgatccagtctcaggtatttcttcatagcagtacaaaacagactaacatagagacactggaaagtgtttaataaaaatgctgggtaatagttactgagcataaacgatgtgccagacacatatgttcatagatttcatcctcaaaaactacatgcgtgttttcccaagttcacagagtgagtggtaaccactaggcacctctgcctctgtaccatgtatcacctcctttttattttctaaaacaatgcataggataaccatcacagtttctatccaacattacatacacatacgtgtgtgtgtatgtctggctctctggaggcaagatgatgggtgattttaatttttttctttgtgcttcccagtttttctgcagcatagatggataaatgttataaaaag

SEQ ID NO: 46790 - DNA, 2495 bp, Homo sapiens
  misc_feature (3)..(3): n is a, c, g, or t
  misc_feature (6)..(7): n is a, c, g, or t
ggnacnnggctgggcttctggcttcagagctgggaattgtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtccactcaagccacagtggagatgaccgtcagcatggcccaggtcggggctgacgcggccatggtggtgaccccttgctactatcgtggccgcatgagcagtgcggccctcattcaccactacaccaaggttgctgatctctctccaatccctgtggtgctgtacagtgtcccagccaacacagggctggacctgcctgtggatgcagtggtcacgctttcccagcacccgaatattgtgggcatgaaggacagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcccccttgcaggagctgagccccgctgaggaggaggcactgcgcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttctttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctccacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaa

SEQ ID NO: 46791 - DNA, 1284 bp, Homo sapiens
tcctcctcagcggggctcagctcctgcaagggggcgccgttgctggtgaaagtgcagtgcgcagtgcctcctccgtcagcggggctcagctcctgccagggggcgacgggcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttctttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctccacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaa

SEQ ID NO: 46792 - DNA, 1341 bp, Homo sapiens
  misc_feature (3)..(3): n is a, c, g, or t
  misc_feature (6)..(7): n is a, c, g, or t
ggnacnnggctgggcttctggcttcagagctgggaattgtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtccactcaagccacagtggagatgaccgtcagcatggcccaggtcggggctgacgcggccatggtggtgaccccttgctactatcgtggccgcatgagcagtgcggccctcattcaccactacaccaaggttgctgatctctctccaatccctgtggtgctgtacagtgtcccagccaacacagggctggacctgcctgtggatgcagtggtcacgctttcccagcacccgaatattgtgggcatgaaggacagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcgaaaatcctttgagagaacatcccagtgtgggaactccttgtgactcccagaaaatcctgacttcggacaaagtcgagcaccactgattgtcaaacttaagtgtgcattaaaatttccttgggggcgaattaaagttcca

SEQ ID NO: 46793 - DNA, 2006 bp, Homo sapiens
  misc_feature (3)..(3): n is a, c, g, or t
  misc_feature (6)..(7): n is a, c, g, or t
ggnacnnggctgggcttctggcttcagagctgggaattgtgggaggagggcccagatcccactggagataccgaaggagatactctttagtattgggatcccagaaaccagtcctatatctggccagagggacactgggttgtggcatctctctagctgctacccagaaggaacagggccccctggggcctataggccttgcccctgaccctgggaacacccagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcccccttgcaggagctgagccccgctgaggaggaggcactgcgcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttctttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctccacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaa

SEQ ID NO: 46794 - DNA, 2158 bp, Homo sapiens
agcaggctggtaccggtcccgagagtcttagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtccactcaagccacagtggagatgaccgtcagcatggcccaggtcggggctgacgcggccatggtggtgaccccttgctactatcgtggccgcatgagcagtgcggccctcattcaccactacaccaaggttgctgatctctctccaatccctgtggtgctgtacagtgtcccagccaacacagggctggacctgcctgtggatgcagtggtcacgctttcccagcacccgaatattgtgggcatgaaggacagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcccccttgcaggagctgagccccgctgaggaggaggcactgcgcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttctttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctccacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaa

SEQ ID NO: 46795 - DNA, 400 bp, Homo sapiens
tggggggcgtctgcgccctggccaatgtcctgggggctcaggtgtgccagctggagcgactgtgctgcacggggcaatgggaagatgcccagaaactgcagcaccgcctcattgagccaaacgctgcggtgagccagtggcagcgggggcgcggcctggcggggggtgggcagtctgtgtcctcattggagcaggacccagggctggcaccaggccccactcagtctcttcctttcagaaaatcctttgagagaacatcccagtgtgggaactccttgtgactcccagaaaatcctgacttcggacaaagtcgagcaccactgattgtcaaacttaagtgtgcattaaaatttccttgggggcgaattaaagttccaacttttgggcccaagaagatgca

SEQ ID NO: 46796 - DNA, 1021 bp, Homo sapiens
tcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataattatttttggttcatctaatttaatccaatatatctaagatactatcagtatgaattttgtataaaaattgttaatgaggccgggcacagtgtctcccacctgtaatcctagcactttgggaggctggacatggtggctcatacctgtaatcccagcacttttgagtggctgaggtgggtggatcacttgagcccaggagtttgagaccagcctgggcaacacggtgaaaccccatctctactaaaaatatgaaaaataggcaagcatactgatatgtgtctgtagtccctgctacttgggaggctgaggtgggaggatcactgaagcctgggaggggggcttgcggtaagccgagattgtgccactacactccagcctgggcgacacagaccgtgtcttta

SEQ ID NO: 46797 - DNA, 167 bp, Homo sapiens
tgctcaaacatgaataatttctaggtggctgcacacccatctcaggagtgactcgtgagggagattttagcatcacaaaggaaagtggcactgtgagcctgggatctgtggccctccctccacctccggtgtggatggagtggtgctgtgatgtgcctggtacaggg

SEQ ID NO: 46798 - DNA, 156 bp, Homo sapiens
ttcctggtcatactaaagaatctcagctagtggtgatctaccagtttctgtgaggattattactgtattaatgcattttgggaggtgttcattcagttcagagtgaatgctttggaagacattgcacagcttgaatcatggggcatcagggatagc

SEQ ID NO: 46799 - DNA, 295 bp, Homo sapiens
gttttggaaaaagcaacatttgggcaggaaaacagggatgtgaagttctcatttagggctgcaggcccagggttgtgggtggggcctttgctggggaaccgctctcttctagccagcatttccctgcctcctgtcgtatccattggaatacacttttcaagcttttgtctatgatttttttctttgctccggaaaggttctcctcaaagggcgcagaaagtagaacacagaatttggggattctctgtgctgaggggctcaacaaggtgtcctgtgctaagtgttgtaacttggg

SEQ ID NO: 46800 - DNA, 361 bp, Homo sapiens
agaggaagagagaaagcatttggttgagtttaatacttagatctttttatcaacatcttgattataacacatgctaataatgtgtagcatccattactagggaccctgtggaactgtgttagagctctagatccattttattctctgtagccactacaaaatttggaaaccggcctatttgagtcttattcataatggtagatctcataaatatctgcctggttgtatgagattaagttttttggcacatctactgatagctgagagagaaaataatactttatctgtgtcttcgactaagtcatatgtttagtgtgtgaatgttttactttgtattaatagaaggtgtttgtgcagttaa

SEQ ID NO: 46801 - DNA, 452 bp, Homo sapiens
ttactttcagaatcctcttaaacctcattattggtcattataaaattccagccacaattagaaggatttcccagagttagctttgtggttcttgaaaaagggctgtgtttctaacagttcccattaggtcaaagatttaaatataatgtacaagtgacttaatggagcccttcagaaaaataaagcatttatcattttcctggaaggctttttacactgttaggttcaaaagtacggacttgccctaagaatattttgatcttttcaataagtgtttaaagatatcttatttactgttgttttgatgacatttgtcaaaatactaacatttggtatcttctttttaaaaagttttttttattggtgagacagggtctcagtctgtccacccaggttagaatgtggtggtgtgaccacagctcactgcagcctcaacctcctttgctcaagtg

SEQ ID NO: 46802 - DNA, 444 bp, Homo sapiens
tgtgagatggtttctcattgttgttttgatttgcatttctctactgaccagtgatgatgagcttttttttcgtatgtttgttggctgcatgaatgtcttcttttgagaagtgtctgttcatatcctttgcccactttttgatagggttgtttttttcttgtaaatttgtttgagttcattgtagattctggatattagcccttaaagtaagtacattttttgtcactgggtaatataaagaaaaatgttatctgtcatcagatcaccttgggtcattagagaataaagcaaggactttctctctacaaattgctggtttgcgtgtgtgtgtgtgtgtgtatgtatgtatgtgtgggtctgtatgtgtgtatatgttgattaaatattaaaggaattaatcattagcaaagttgggctgccaattgtcctccattaactgagagt

SEQ ID NO: 46803 - DNA, 294 bp, Homo sapiens
aatccaacagaaattgaactgaatgaaataatggccacactgctcaatactatatggcagagaatatggtcatgctgacttgttgtgaaggtacaggtatatattttttttatgtcatttagtaaattataataaactagggcctgttgcggtagctcacatacgtaatcccagcgctgtgggaggctgaggcaaaaggatcccttgggcccaggagtttgagacaaacctgggcaacagggggagaccccatttttacaaaaagtaaaaaattagccgggtgaggtggtgcat

SEQ ID NO: 46804 - DNA, 233 bp, Homo sapiens
aacaatctccagaggtcacacagggcctataaaaccacagttaacttagaagaattttgcagccaggtgtggtggcttatgtctgtcatcctaaaactctgggaggctgaggtggccggattgcttgaggccaggacttcaagcctggcctgggcaacatggcaaaacccatctctacaaaaaatacaaaaattagccaggtgtggtggtgcccacctgtggtcctagttact

SEQ ID NO: 46805 - DNA, 1457 bp, Homo sapiens
agatctccaaaattaactgagattaactaatgctctctagccttttaggatctttgtgttgtaacttatgaaacatgtcttagaaaacattaatctggaggaaatcattaaaaagtgtcagaggtaaaaaagataggaagaatgcatgggaaggggagaacaaagaggattagagtcaaacagtcagaatggggcagcaagttcaactgtgcagtcagcctgagttttaaattttgtccttagaaaagcatgtgaactcccagggtgttagtgttcgagtagacaggcaaggaattctgtttgtcagcttaaccacatcttgtagcgtttgacctgagcacgagtgtccaggtatattttgagtggtacatttatctcctggcttaaagcccttactttgtttccataaaattaggacagaggcaaaaaggcattacgggatagcaccagccaattgtacatcaccttttgaatcattttcttgaaggattgtcaatattctctgacatatatcacctgacaaaaagcgaacaagcctagacaaactgaaaaaggaagcattcagtggttggagctgagcactactgtgttcttttgtgagaggccacacgttttcttattgaagatttggcttcttcggtattgtgaataattatttcttaattgtgaaaatggatgtcagttcttcttagtcactcttccaaaagctaatataaatttctgttgttgtcatttaaaaaagggataactgtattgcatttctgggtttgcagatttctaaccagtttgtaggcatttttgttctagagtgggctccttaagaatctgtgagcaagttgcagaattagagtgtttatttataggtcaggggccaagaatgctcatttagctgttaattgtggcaggatgtgacttttgaaagctctgaacatatacctatatgcaaacagtatgcacacttatttacctatttagcctcagtggaaaaacagcctgctctttgagcttttgagaatgtttccccaatgtattgtgcttctaaatgtaatgcacttgctttaatgcttttgttctcaatcaatctctggaagctattccaaacatggcatttctcaaggaaaatttcttgaatgtgcaaaattattctccaatgtgtaaaagtgacaggccacctttccctcatgccttatacctccacccaaaatacgcaataagcactcaaggcagaatggggggtcttcaggtggtcatttggccgtgctgtaaagatggccctgcttctcccagtacaccatgatattgaagaaggacactgtgtaaataaactcttgtttctagataaagcatggggacacaatttcatttcttcttagttccatctctagttggaaagcataatctgtttttaatatgctggatgcaaaaaataaaattcctgggaaaattttttaaaaaag

SEQ ID NO: 46806 - DNA, 690 bp, Homo sapiens
ctcaccatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaatcggatgtctaatcaaggacttgtttgataaaattggtctaggcttcttacaacaaaattagtttgtatcttggttattattaaacagtatctgggactggtttgggtagaatattaaacttattttgttgccagttattgtttacc

SEQ ID NO: 46807 - DNA, 583 bp, Homo sapiens
ggtttctttaaaatttgtggacaaaaccaggtcagaaattaataagaacattgttggtttttcaccaaggtactggggaatggtttggcggtgggtccaagatagaattaggcctctctggaagcattacttccagaatacccagggtcttatttttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaatgagctttcaaaacgttaaatgaaatcggatgtctaatcaaggacttgtttgataaaattggtctaggcttcttacaacaaaattagtttgtatcttggttattattaaacagtatctgggactggtttgggtagaatattaaacttattttgttgccagttattgtttacc

SEQ ID NO: 46808 - DNA, 610 bp, Homo sapiens
tccatccttcctgctgtaaaatgtgtaattctctcagagaggcgcacaagaacccagcaacacaagggagagccttggttcactcctggcgtggcttaaccaaccaccttccaagtccctgtgtatcagcccagtttatttttctctttatctttaaactatcaaataccaccctaattgtatatttaacctatttccatctggatactatattaagcagttgtatgctcaccctatctttttcttcactggcaaatctgaaagaatttgaagataaacctatgtaagcacacttcaaagtacaaaataacaagtatgcttggttaaattcatactctagtcacacaggcacacagaaattctgtggacagaaacacataaggaccataaaaatcaagctttgtattaagtaggtgtaactcttaaatcgtatggttccaattcatgcttagggactgctatctcattacacagcagccaaccgttttgttatcactttctattttttcaatatgtttgcatcacagcacagccttagaatattttctagaacaaaattcatcatagaaaatttctaaaaaccttttgacaacttctcattaaaattgta

SEQ ID NO: 46809 - DNA, 1258 bp, Homo sapiens
tggggtttcaccatgttggccaggctggtctcaaactcctcacctcagatgatctgcccaccttgtcctcccaaagtgctgggattacaggcttgagccactgtgcctggccttgttttgtgttgttttgttttttgagacagatactcactctgccccccaagctggagcgcagtggtgcaacctgggctcactgcaacctctgcctcccaggttcaagcgattctcctgcctcagcctcctgaggagctgggaccataggcgcatgccaccacgcccagctaattttgtatttttagtagagatagggttttcaccatgttggccaggctggtcttgaactcctgacctcatgatccacccaccttggcctcaaagtgttaggattacaggcgtgaaccaccacacccagccagtaggcataatcgtaataaaaatagtttatatacctggtgctgaagtaaaaagatcacagaaaagtaatctgccttttatcctgtctttaggtcagaggttaggttgtggtttatgtggggttttttgacacaggaggagctacctcatttccattctgaaaagtaaagtttgttaatttggagagcaattgaataggaatcttggagaactgatatgttaagactttcaccatgttttgcagcagcttttttttctgtgtcagtcacaaaaaggcaattcaaaattaaagacatgaaggtgtggccgggtgcagtcactcacatatcttgagcacaggagtttgagcccagcctgagcaacatggcaaaaccacgtttctactaaaaatacacacaaaccgggcatggtggcgcactcctatagacccaactactgtggaggctaaggtgggaggatcacctgagcctgagacgtcaaggttgtagtgagctgtgataatgctactgctctccagcctgggcaacagaggaaaccctgtctggggggaaaaaaaaagacatgaagatttatctgaattgtagagtgaagtgatactactattcttattacttactgaaataattcacttaatgattgtgttccagaaaagaacattggcttagacagtagctttgagagagaagggcctctattttaggcacatactgtgatttttgtgcatatagctaattaattatgttaatggattatttaacagattcttttgttgttctgctataaaatttaatacagtaggatacttaagaaaaacaaagcttacattttgtgtacgagattttgg

SEQ ID NO: 46810 - DNA, 415 bp, Homo sapiens
aaggaacgcactcttgagataatggtattaatccacttgtgagggtcgtacccctatgacccaagcacctcccattaggccccacctcccaccattgccatgatggggatcaagcttctgacacatgaactttggggggcactttcaaagcatagcaccatctttgctacaaactggaatgagcctgcctgagaacaaagccaaggcagggaagtagaactgagggatgctgctgaaaaaagggaatagaacagataaacattgtgtgagcctgggtcgagctcaacctgaagcctgtagtatcctgggccctttagttatgttaaccaccaactctccttttagcttgaaccagtttcagttgcatttctgcctctcacaataaagggagccttgactgagacccactaataga

SEQ ID NO: 46811 - DNA, 460 bp, Homo sapiens
ggtatttttcaattatcttgcagttgattttctaaattcactcttcaattcatgagagaaagtggcttttatggggcaaatacatactatttgggcattagagaggacagagattattttattctttttgtattgaataattttgcaggaagctgctgctgattacaaggagagttatatgtattaagattgataaacagaaatatttttaaggcttttagatttccctataaggagataggatttacattccaactttgattttcttcaaagggatcctgtttgcttaaattctcagaaaatatgattggacttctcagtcaactgagctgtaagagtggtgaagaacctgccctcaggaagggacctgtcaacatttagagggtgtgggggtggtgatattggggatggagactggcatgatggaagggatgaggcctagaacacaagcatatcgaac

SEQ ID NO: 46812 - DNA, 410 bp, Homo sapiens
gtctgaataactgagggggagagactgcgtccctcagcggcttctcgaccttaggttcgcatcatggctgggcacctaccagcttctctgtgcctcagtttcctcatctgggaattgtggattgcaatcctatctacaccccagtctctaatggagatagtgtatgcaaagtacatctacgtaggcctgacacacagctagtagccgtgtggcagccagcccagggttgttcttgggaacatgggacagcacactgcctgtaaatttggtggctctaggattggccagacatcttctgtggaaaaccaggcggcgcatgctaagacacggtgggccatcgagatatcgcagtctgggaagctttccgagcgacgctgagcagctcggacagtgccagagactttggcagc

SEQ ID NO: 46813 - DNA, 314 bp, Homo sapiens
atcccagaaacctttgcaaaaagcttgcaatgaaatttaagaagttcttcgatttcggcgccattttcgagtggagccagaggtgacatgcgattttttaaaaaagggacttggtggctggcgtctttcccgactgtaacgtgggttacggcaggcagaaaaacatctggtgataattctgaaaaaagtgctgtggcgtttgggggggttgtaaagcacgttttgcgggcgggatgggggcaaatctgacatttaaagtgtttaacaaatgagtgcggccgggaaattctcaggaaacggactgggaaaaaaaa

SEQ ID NO: 46814 - DNA, 325 bp, Homo sapiens
gttaaatataattccaactctaatcaatcttaggatgctttaacattttttctttaatttcctaaaaaaaaaatcaaaagattcatgtgatgaaacacatctgataccctccttggagaactgcagggcttagagaaaactcattctgtgttctctaccgtcagcatttttattccagtgaaatttattttaaaattagtttaattttagaaaaacatgttttaaacctgaaagtaatgaagattatctagttcagatttttcatgttgaaaaaagggtatttcctagggtgagagaaagttagtggcaaagcatttcagtattt

SEQ ID NO: 46815 - DNA, 380 bp, Homo sapiens
cactacagcctccgccttccgggttcaagtgattcctccctgccctcagccctccccaagtagctgggattacaggtatgtgccaccactcatggcctaattttgtatatttagtagagatggggttttgccatgttggtcaagctggtctcgaactcctgacctcaagtgatccgttccccgcttcacctcccaaactgctgggattacagatgtgagacacccacacccagccagctccctgcaaacttaacaacaaataacctactgttgactagaagccttactgataacgtaagcagttgattaacacatattttgtatattatatattatatgctatattctcacaataaagtaagctagagaaaaaatactaa

SEQ ID NO: 46816 - DNA, 670 bp, Homo sapiens
ggggatatttcacggcctcttctcaaggttgcacttttgccagctgccagggatcgtctcaaaacaggttcttagtgcattcatagcttgagctgctgtcttgaaagtagtacattcctttttctgccaacttttttctgagaaagtttttgaatgcacacgtgcacccaacagagtgagagtggctgttaagagagagggcgccatttcctttgccctccagcctgtccctgtgcaccctggaggggcccgttttttccaccgcttagataaaatctagggcaagttcctgaacttctcttttctctctcaggtaacaaaaattcttttgggctcctttagtcacaaagatattcacgatttcaggtattaaagtgcccagccctgggtgattgtcaaaattctgaacttgatttaaagtggcacctcctctcacagtcttcgggagggagagaccggagccaggagtgcagcgtgtttgctggggtctgtcgtggcccactccacacctgctgggtggatccggctggtgccccatgggcgcctctgagatgcccctccccaccccatcagtggcgctgtctcacctgcaggctgcttctcacaggtggtcccccctcactcctcctgcagccccagttcctggctgttcattcttattgggacccgt

SEQ ID NO: 46817 - DNA, 482 bp, Homo sapiens
ttttgtttcagcgtgaagctccgctcgctgtaatagccatgaaatgcatcttaatgtaaaacaaatgaattgactatacccttcagcactttcagtgacagggctgatgcacggaaatagatgagcagcacagaaaactcaggataattttaaagccatccatctggggtaacggcgagcatgtgccttcgttttcttaatggcagttttatggagctggggagcaggatatgcagtgggaaggtctctggctccaatctgcattcttctttcttagctgtgccatcttgggcatgttacccaagctctccctcttaggctcttcacctgtagaatggagttcacagcagccatcttccacgatggtggagaggattaaatggaaaaacacgtgcatgcagtacatgttcagtccttgcttttgtatatttttttcggaacatctaggaattgtggagccatcgcattattttttatgaccc

SEQ ID NO: 46818 - DNA, 367 bp, Homo sapiens
tccagttagaagtgaggttgatagtgtcacttcagactaggtcctgtaaaacttctggcatttagaatggtagtgtaaagccacttcctctgtttaactaatagacatcagtttctttgtcagcaccttacatggtactgcgtgcagtttgttcatacggaattaaaaaacatgtaactcttctcctttgcaaggttttctatgagtttccctgttttgttatttaatttctttaaaaaattagtctgtatctctgggctctcctaggtggaaggaaagtaaagctggaatgagggagaacccttaccctaaaggaaaattaggtgacattagggtccctttagtcactctatgttaccttatttat

SEQ ID NO: 46819 - DNA, 5450 bp, Homo sapiens
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccacaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaaccaaccctcacttcacagggtctgtaagtcactcatagaactttgctcttcccgagacagggtcccttccccagctcaggcacaacagagtctggcaggctctggcaccctgggcctcctccgggagcctcccatctgggcagtggagccataaacggggatccgagaagagagtatccacttttttttttacaggaagaagggactcacagcataaacgggggtgggggggatcctgattttgaaaataatctatttgtagcttctcttctatcaaaaccaacacatcctcttctttctgccaatcctctcccccacgggacacctctctggttcgggaccaatccctccctggggacgtgccccacctgcgtgccggctgagctcaggaacccctgcctgccccccgggtggggctgcggctctggcctcccaggcccatcctcaacagctaccccagccaacaccaaggccacaaggggaccccggcctaggaggcaggaagccaaggtacagagagcagcctggccctcaccagtgcgcaagctggggcagcaaggctgacagttgctgcatgcccagggcagggtgtggtactggcacccaagttcagcatggcagagctggccaacagcttgtccccgatctgcctccagccccaagatgcctacagcccccaggccccttcggcagcactgcctctgcccacctgcctttaagagactccagggctgctcctgtcatgcagcgaaggttttgtctgtttcaaagttcgagactcaacttgagggactgtttttgacaatccccgctgacctccgctcctcgtggcgccctggccctacacccagcctggcccagggccggctttgcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagaccccgagccgcctgccgactgcctgcacagggagagcagttgaggcccgggcagggcccccacaccagaccccaacatagcttccccacccaggcaccccctcccggggcagcaggcgtgggagtcagggctgcatgctcctcccctcccacctcacaggcggccttaggcaagtcattttctgtcatcacaaggtcgcctctgcctagtcaggtcctggcgtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctc

SEQ ID NO: 46820 - DNA, 5746 bp, Homo sapiens
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccacaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaaccaaccctcacttcacagggtctgtaagtcactcatagaactttgctcttcccgagacagggtcccttccccagctcaggcacaacagagtctggcaggctctggcaccctgggcctcctccgggagcctcccatctgggcagtggagccataaacggggatccgagaagagagtatccacttttttttttacaggaagaagggactcacagcataaacgggggtgggggggatcctgattttgaaaataatctatttgtagcttctcttctatcaaaaccaacacatcctcttctttctgccaatcctctcccccacgggacacctctctggttcgggaccaatccctccctggggacgtgccccacctgcgtgccggctgagctcaggaacccctgcctgccccccgggtggggctgcggctctggcctcccaggcccatcctcaacagctaccccagccaacaccaaggccacaaggggaccccggcctaggaggcaggaagccaaggtacagagagcagcctggccctcaccagtgcgcaagctggggcagcaaggctgacagttgctgcatgcccagggcagggtgtggtactggcacccaagttcagcatggcagagctggccaacagcttgtccccgatctgcctccagccccaagatgcctacagcccccaggccccttcggcagcactgcctctgcccacctgcctttaagagactccagggctgctcctgtcatgcagcgaaggttttgtctgtttcaaagttcgagactcaacttgagggactgtttttgacaatccccgctgacctccgctcctcgtggcgccctggccctacacccagcctggcccagggccggctttgcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagaccccgagccgcctgccgactgcctgcacagggagagcagttgaggcccgggcagggcccccacaccagaccccaacatagcttccccacccaggcaccccctcccggggcagcaggcgtgggagtcagggctgcatgctcctcccctcccacctcacaggcggccttaggcaagtcattttctgtcatcacaaggtcgcctctgcctagtcaggtcctggcgtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaaggctggtgttctccacttatttcagcgacaagctggggccaggcctcaggggcacgcctgggggcaggggagggagttcctgcccccaactgcaggacaggcactgcccaagtctgccctgaatccgaggacaccggaactctgctcatacaggcggctcggctggcctggcacaagcctcaccttctaagctgcgagccagaggccactgggttctctcacgtggtgtctgctgttacctctgagagctgggacataaccaaaggggggttagtgtgtgagagaagcaaggcc

SEQ ID NO: 46821 - DNA, 2904 bp, Homo sapiens
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccacaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgccgcaggcctcgtgccgaggaccagggcctgaccaaggaatacggcaactcactcactgcaccgcttcaagaaccgggctccaagaacttccagacaattaccgccctcgctc

SEQ ID NO: 46822 - DNA, 1426 bp, Homo sapiens
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagctcccacctcacaggcggccttaggcaagtcattttctgtcatcacaaggtcgcctctgcctagtcaggtcctggcgtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaaggctggtgttctccacttatttcagcgacaagctggggccaggcctcaggggcacgcctgggggcaggggagggagttcctgcccccaactgcaggacaggcactgcccaagtctgccctgaatccgaggacaccggaactctgctcatacaggcggctcggctggcctggcacaagcctcaccttctaagctgcgagccagaggccactgggttctctcacgtggtgtctgctgttacctctgagagctgggacataaccaaaggggggttagtgtgtgagagaagcaaggcc

SEQ ID NO: 46823 - DNA, 157 bp, Homo sapiens
agggtctgacctcatgggtgggtgggcactgccagtgtcctgtgctctcagggccacagtgactggcaggtggcagcactgaccccctcctcccccaggtgcaggtgggaagcacacctcaggaccaaagaatcgtcgggtacatcgcctgcacaca

SEQ ID NO: 46824 - DNA, 891 bp, Homo sapiens
ttccgcgtggtgtgttggcccccccgtggttgtcgccccccccgcccggtgttgggggttccttctctccacccagtgtgctccccgggttcggccctgttgttgtccccctggctgcgcgcgcttgtgttaacgccgcgcgcccgcgtgcgtctgcgcgtcttatatgagcgcgcgtcccctcctatggggcgccccctcttgtccccaaaaccctgggtcgtgcgcttctcttgtcggccccccctcgggggaggaattttatgatcccgccgccccccctttttttcttttttttttttttttttttttttttttttttttttttttttttttttttactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaaggctggtgttctccacttatttcagcgacaagctggggccaggcctcaggggcacgcctgggggcaggggagggagttcctgcccccaactgcaggacaggcactgcccaagtctgccctgaatccgaggacaccggaactctgctcatacaggcggctcggctggcctggcacaagcctcaccttctaagctgcgagccagaggccactgggttctctcacgtggtgtctgctgttacctctgagagctgggacataaccaaaggggggttagtgtgtgagagaagcaaggcc

SEQ ID NO: 46825 - DNA, 5388 bp, Homo sapiens
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccacaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaaccaaccctcacttcacagggtctgtaagtcactcatagaactttgctcttcccgagacagggtcccttccccagctcaggcacaacagagtctggcaggctctggcaccctgggcctcctccgggagcctcccatctgggcagtggagccataaacggggatccgagaagagagtatccacttttttttttacaggaagaagggactcacagcataaacgggggtgggggggatcctgattttgaaaataatctatttgtagcttctcttctatcaaaaccaacacatcctcttctttctgccaatcctctcccccacgggacacctctctggttcgggaccaatccctccctggggacgtgccccacctgcgtgccggctgagctcaggaacccctgcctgccccccgggtggggctgcggctctggcctcccaggcccatcctcaacagctaccccagccaacaccaaggccacaaggggaccccggcctaggaggcaggaagccaaggtacagagagcagcctggccctcaccagtgcgcaagctggggcagcaaggctgacagttgctgcatgcccagggcagggtgtggtactggcacccaagttcagcatggcagagctggccaacagcttgtccccgatctgcctccagccccaagatgcctacagcccccaggccccttcggcagcactgcctctgcccacctgcctttaagagactccagggctgctcctgtcatgcagcgaaggttttgtctgtttcaaagttcgagactcaacttgagggactgtttttgacaatccccgctgacctccgctcctcgtggcgccctggccctacacccagcctggcccagggccggctttgcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagaccccgagccgcctgccgactgcctgcacagggagagcagttgaggcccgggcagggcccccacaccagaccccaacatagcttccccacccaggcaccccctcccggggcagcaggcgtgggagtcagggctgcatgctcctcccctcccacctcacaggcggccttaggcaagtcattttctgtcatcacaaggtcgcctctgcctagtcaggtcctggcgtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctc

SEQ ID NO: 46826 - DNA, 4791 bp, Homo sapiens
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccacaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagaccccgagccgcctgccgactgcctgcacagggagagcagttgaggcccgggcagggcccccacaccagaccccaacatagcttccccacccaggcaccccctcccggggcagcaggcgtgggagtcagggctgcatgctcctcccctcccacctcacaggcggccttaggcaagtcattttctgtcatcacaaggtcgcctctgcctagtcaggtcctggcgtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaaggctggtgttctccacttatttcagcgacaagctggggccaggcctcaggggcacgcctgggggcaggggagggagttcctgcccccaactgcaggacaggcactgcccaagtctgccctgaatccgaggacaccggaactctgctcatacaggcggctcggctggcctggcacaagcctcaccttctaagctgcgagccagaggccactgggttctctcacgtggtgtctgctgttacctctgagagctgggacataaccaaaggggggttagtgtgtgagagaagcaaggcc

SEQ ID NO: 46827 - DNA, 2708 bp, Homo sapiens
  misc_feature (2572)..(2572): n is a, c, g, or t
  misc_feature (2579)..(2579): n is a, c, g, or t
cgccggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccacaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggnttataangaaaggtgtattgtggtatatgatattattttgatgtttattataaaaatattgggatttttatattttattgtatgttatgtagattgaatgattattttaatattatatttaatgttttaattagat

SEQ ID NO: 46828 - DNA, 425 bp, Homo sapiens
tactcggcgtggtattatttttccacctgatttgcaaaccaagagaatgatagcaaatgttggcctcctttcctcctcagcatgaccagtcacccatgtggtaggataatttattgagatattaatgtgttttttgttcttccggaattttacccacccctgttctcagaagatagctgggcctttgtgttccttgcctcagagtgtttttaggatccaggaccaaggggaagtttagacaggtagccaggcttctctcactccttccttggatttttaaaaatgtctaggctcggccaggtgcagtggctcatgcctgtaatcccagcactttgggaggccgaggcaggcggatcacaaggtcaagagatcgagaccatcctggtgaacatggtgaaaccctgtctctactaaaaataccaaaa

SEQ ID NO: 46829 - DNA, 466 bp, Homo sapiens
aaaatttcagaaatgacagcgctagtttatgctgcagtatctagtacaatagaacatttctgaaactggtttctttttctctccttgcctgaccttgtaagacactgaactacaaaatgtggcttgcctcttaatattatattctctaaagctggagatttttcaattgtaactaagataaatcacaccactaaaaaatataaacataaagtttgtggtcagtgatggttccactccttgagattgtaattcaagaacaagagcagcagagttgctgaggctagttagtggggtaggggaatctgtaagacatacacagcaggtgctcgataagtagtttttccaagtaggaacaactccaacaggagttgttcttgggcaatggttgggatatggggagtctatagctgagaaagaggaggccggacacagtggcttacacctgtaatcccagcattttgggagg

SEQ ID NO: 46830 - DNA, 409 bp, Homo sapiens
tcctgagcatgctggctagctcaaagacagtgtacacactgttcatcattccacagatgctctccagcttcgtaacccagacccagccaatctccctagcaggttgtaccacccaaacgttcttctttgttaccttggccatcaacaattgcttcttgctcacagtgatgggctatgaccactatatggccatctgcaatcccttgagatacagggtcattacgagcaagaaggtgtgtgtccagctggtgtgtggagcctttagcattggcctggccatggcagctgtccaggtaacatccatatttaccttacctttttgtcacacggtggttggtcatttcttctgtgacatcctccctgtcatgaaactctcctgtattaataccactatcaatgagataatcaa

SEQ ID NO: 46831 - DNA, 401 bp, Homo sapiens
taaagcagactcaataattagtgtgactcagaagaaaatactgaaatcttagaatgtttactgtagaaattctcatggaaaattatttctaaatgtttttaaaacttatatgttaaatattgtagaattccatatctttgtcacccatagtgggcccattgtttatgtgtcacccttgggttctcctgtgttatacagaagatgtagactggcttgctcaagtaatcatgggacatgatattgaggtcctgacctcttctagcattacatgggcagtggcatatggtggggaggttgggaggagtgggacaccccagtacaggcaataaggaggtacattgtctgtagataattttaaaatgacagtaaacctcactaaaataggtctggtttttattatg

SEQ ID NO: 46832 - DNA, 502 bp, Homo sapiens
ctggggtcttgaattagggttttcatctctctgggttcacctcgcacgctgcttggtctttagaataaagattgaggttatcaagacctagaaaaatgacttttctgaacttgaaatatttcctttgaatgctcaggagtcaatatacttttgttattcagaacacggattccaagttagatatactcaatttgaatctcacctgtcattgatagaattatccgtgtaactttgtgaaaaccacctaacttccctgtaccttagtttcattgtcaggaaaaactatggtaataattataactaccttgtattgttgtttcaaggattaaatttgaaatgcacaaaaatcctttagtacagtcccaggtagagaataagtgctgttattattattttaaaaattttgtccccaactttttattgtgaaaatttcaaaattatagaggttgaaaaaatagtgcaataaacatccatatactctactgatattaaaaaattgtta

SEQ ID NO: 46833 - DNA, 363 bp, Homo sapiens
aataaccttaaaaacaattaaaccactagtttggccaaagttaaaagcaataaattaataagcttggtctagagcaggtgtttaaaggatgattcttagtggccaagtaatgttcatcccaggaatgcaaagatagcttaacattaataattccctagaagtcatgatccacactaacagatatggggatgggaaccacataaacagttaaatagatgcagaaaaatcacttaataaaatttgaagcctgttcataatttttaaaaagttttcaaggaacagtagaggagaaggagattaagaagttttcttcagctctgaaatagtttctgacaattttttgtttccctcctggagggaagc

SEQ ID NO: 46834 - DNA, 461 bp, Homo sapiens
gcatgatagttatctgattcaggacttttaaaacacacttgaaatatgacaactgcttgttattctagctcgataacaaatctaagggcaagctattgagcactgatttgtccttttcttcctcattccagctgctatggacctaaagtggagggctttgaaatttcctgcttaattgggctgcatgtcattgctgtccttagaagttgctctgggatgcaggtgctggtttcttggatctcctttgctggaattttgcatgtcttgttttgttgttgtaccagctttgtggatcagccaacatccttggcttgccctgtggggagtggggtgggacacatcttggattgctctattccagggatgtccaacattttggcttccctaggccacattggaagaagaagaattgtattgggctacacataaaatacactatcactaaaatagctgatgagcta

SEQ ID NO: 46835 - DNA, 1671 bp, Homo sapiens
aggaaggaaatgagggatgacccttgggaacgtttgaaggaagaaaattctagacagaggatatctccaaagaaaggtcccaaaaaggaagtgtgtctaaatttttgaagaagaataagaaagctgacaaggagtaggtgatgggggagttagaagcgatgaagtcagagacatattaaggaaggcagagagtggagtagcaggttgttgtagatcatcgtaggaaatcgtaaggatgttgccttttattctgtgggataatatctgctaaaagctgttgcatgttactattattacatcatccacagcctgagactttgcaaaaacagggttggtactctgtcagattgtaaatatcgaaggcttgcaggccaaatgatatctactgcaactgctcgaccttggtgttgtggcacaaaagcagccatgggcaacctgtataaaatggcatggctgtgaccccaaaaaatgtatttacaaaaagaagcaggtagcccacaggctatagtttggccgcctctgatctaaagagttactctgatttatatctatattttctggggaaaattaagcttaggggaaatgaaaaagaaaactacattgattgactatctgttatgcatcagaaagtgtcctaggaattacatgtgtgtgtgtatacacacatacaaatcgacatgtatttgtaaatacatctctgtaaactagaagaggaagagaatatcctcagtctcataaaagcttttcaaaaaaaaaaaaaaaggcccccttaaagttaaccccttagtggggggttgacggaagggctctctttcccttaaaacggggcaacattccaagaattgttccactttctacttattccattatttcatacattatttacgggcaatgtgcatacccagttattacattattatttggtgttccccactaagtggtcatatttaacattcccttattaattattctactttagccaagaacagctttaatctcctcagtgaacaactacacttccaggtgggccctccatatcccgggaatctcatacctcttacattatttccccgctccacacttcgtgtccaacaagttgcacttcttctcaaacattattacagcatgtccccaacattatttttaacacgcaaaaaggaacctacattaatttagtctttactacaacctttctctccaggaaacacaccagaagaggcgagggcggaaaagaacctccccaggtcccattaactatataaagggtccaggcattataacctctgattacccaaaaacccaagggaccaggttaacgccgtagggcacaaaagtggtccagcagaaccatattatttttcccccacattgaggcattttaagaccccaaatcttctccccccaaattaccaggggacatcctaacgcccaaaattccaaaatttccttaacgacagcctcttctatcacgaccgggagcttaatgtgccccctaacaaaccattcacggttgggaccttttatatcccccctttaatttccacatcataagtggccagggggctaaaacgtcccaaaatctttttacacactctcgaacggctatttctacacaccttttcacagcattccacacaaccgggacaacgggccgctgagctaatacagccg

SEQ ID NO: 46836 - DNA, 950 bp, Homo sapiens
  misc_feature (451)..(451): n is a, c, g, or t
attacaggtgagagccaccttgcctagccccagtcactgttgaggtcaccattttaaagctgaggaaacatgctcagcatggcagcagaagctctggcagtttctgtgtgtctggccccagctgcccaggccccctgaacctgaggggccttgctctggccctggggttggcctgggtttggcacctggcgctcgggcccctgagggcttgcagtaggggagcagtggcttttttgagttgaatttagtagggctggactcctttcctgtcctttctgcaggtaaaggagatgagcagcgttgctctggtacgcagagaagcttccagacactcctgggttgcacgatagattaagtaattctactgatgggcaccagctccatgccaggacccagggctccaaagccatttccaggataaatgcaggctctgagagcgagtgccacggangactcctccatggccgcactttcttcacattggctcctgtgagcttcctcaacgctttcgaagctggccccgcttctgtccactctgcagagtgaacgttgaggcctgcgaggtccctgccatgcctgtctcctcctcccagcagtagtgtgagctctgctccgggatcaaggccagatctttgcagcccatgtgcttggctccctcagctgagcctcaggacgtgggtcctcagtttgtgctgtgcagcgtgaggggccacactgcagtcaagccagctgggtgcaaacagcagcttttcttctacttggtggccctccttgggaaggtccctctgctcctgtaacttcatttcctcattgataacaaagaaaaaaacagatcatattgcctgttgtaaggattgaactaaatcgggtaaagaggctactagatttctgtcaatgatgtccatttcctttgccccatatacgtttccaacttaagagagagagtgtgt

SEQ ID NO: 46837 - DNA, 1063 bp, Homo sapiens
agtatgcacattttaaatgataatagctattgccaaattagtcccttaaatagttagtaccaatttgtagcttttaaaaaatagctctagattttattttttcatttattagacatttactatgtgccaggtgcatggttcatggctttttggaactcatcatccagtgggagaaacaggcatttgactaatactaatataaaactatacctgcagttgtaatgagttatataaaggaaaagtgtgggttataagggatgattataacaggatctctgaaactacactggtgaattcagatggcaattaaaggattttaatcagttgtcctagttatttaatcttaatgattgagccagtttctacatcaattaatatatagtatgtttatatatatactttttaaagacatatgtacaaatgtatgtgcacatacccatccatctgtgcctgtatgcatgtatgatatctgataggtattcacattttctttattccatttaaacctctgatcactactcttcttctagcccccttgcatcatacaaatctacccttttctactcttcaaagttgactttattcctccagttttacagagtatttagaagtcactagacaggagcaccctcaccttcccataactgaacctgctagacctacttgtgtctgttactgttctctcctccttctctcctgttaccgtattcttgttaggataggaggggattgttatgtgtccctccaccggggttctctatccctttctctgcctgtattctcagaaatccttaattcccctatcattatcctgttccccagtccctagatttataacccattgtgcaccttcctgagtgcccttttcctcatcatttaaatatgcctcaggtcactgttattttaaacatatttacatgtatatacatgcacacacacctgttcctcattcattcattcattcattcattcattcaagaaacttattttccagtggggaagtcaaataaaatgctaaaagcaagtagaatatatgatatgccagatgttgataaatcaattg

SEQ ID NO: 46838 - DNA, 252 bp, Homo sapiens
agtatgcacattttaaatgataatagctattgccaaattagtcccttaaatagttagtaccaatttgtagcttttaaaaaatagctctagattttattttttcatttattagacatttactatgtgccaggtgcatggttcatggctttttggaacccaattttatttatatggtccttcctttttctccctcactcccatgtcccagaaataacctctaacctttacgtgcacaaaaccttcccaacttta

SEQ ID NO: 46839 - DNA, 640 bp, Homo sapiens
tagtgcggctctgcccttcctggggctgaggaaggcttctgcaggatagctggggggctgggcaggtgggtgaggcagcctccctgctgacactcagtccttgtagctggagcaagatctcctgatccaggtacgggcctgtctgctccaagaaagactctgccaccagatgcaaaggggccctttgttttaacttagtccctggggaccgcctgattcagcacctgtcggcccaggataccccgctggtggggacaagtgcctgagtgtgggccgtgcccgagtgtggccatccctgagtggggccgtcctgactaggaagtggcttttcagttgtgatgtgtgggcctgacctagggggcgctgtggaacccgggctggaaccagccctctgtgccaggccgcagacaggttccgccggccctgaggggcagctgccatggcgtgggtcactgggagctgagaggaagggcccccaccgcacctcaggcaaagcggctctgggaacaccttgatttcgtccatgtgagccgtcccagggagggcagccaagctgtgaagcctgagaaactgacctgtgtgccacgagcttgtggtctgctgcccggtggaggaagtgcaggtgcgcccaggctcctca

SEQ ID NO: 46840 - DNA, 743 bp, Homo sapiens
tctttctgtgcgctggtgttgactgatagcttccgggtggcgctggtcactggaaagaccaaggcaggattagcgggttagaactttcagccccacccccaaccgcggggaggggagaggtccagaggtggaaggtcaagttgattgccagtggggtaatcagttatgcctacttaacaagggctccatgtcaaccctagaagacaggacttggagagcttctggacagctgaataggagggagtgcctggagggcagcaccgtgtccctctcccgtacctcaccctaaaggtctcttcatctgtgtcctttgtaacaacctttataataaactagtgaatgtaagtgtttccctgagttctgtgagctgctccagcaaattcattgaacccaaagcaggggttgtgggaaccccaacttgaagttggttgctgagaagttccagaggcctggacttctgactggtgtctggagacgtggggggcttgtgggatctgagctatctccaggtagatgtctcccggtgtcgggattgaattggaggacaccctgcgggcgcccgctgcagaatggattgcttgctgccgggagaaacccccgcatcttctgggtcgcagatcctgtgccgattgcggtgctggcgtcagagcagaggaaaacgtggtatgagagtttttccaaagagtccagacacgcttccaggccctctcagccacccccacaccgtccctaccattcccacc

SEQ ID NO: 46841 - DNA, 2545 bp, Homo sapiens
  misc_feature (487)..(487): n is a, c, g, or t
ttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaacngtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaagttgctgaagtactgtacagggttgtaca

SEQ ID NO: 46842 - DNA, 2491 bp, Homo sapiens
  misc_feature (487)..(487): n is a, c, g, or t
ttgggcttgtgttgacacggctgataacttgccatcacctgttgccagtgtggaaaaattctccctgttgaattttttgcacatggaggacagcagcaaagagggcaacacaggctgataagaccagagacagcagggagattattttaccatacgccctcaggacgttccctctagctggagttctggacttcaacagaaccccatccagtcattttgattttgctgtttattttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaacngtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaagttgctgaagtactgtacagggttgtaca

SEQ ID NO: 46843 - DNA, 385 bp, Homo sapiens
atctaaaaaatttctttacagaaaggaagcaatgaacagagtgaagcagcatcctacagaaagagagagaatatttgcaaaccacacatgtgataagggattaatattcaaaatgtacacacagcgtaaatgcaagaaaagaatctgatgtaaaaatggcccttccaacatctagcattattgtgtgttgaataaatacttgttcgattaggtctaatcactcttcatgattggatttccaaaatgtggactctcagcaggacattacagggacagtggttgggtctggagatgtcacccttagctgtttttcacaatgagaggttgttttatcataaataaatcaataaatggcagattatacaccggagttactgagaattat

SEQ ID NO: 46844 - DNA, 331 bp, Homo sapiens
atctaaaaaatttctttacagaaaggaagcaatgaacagagtgaagcagcatcctacagaaagagagagaatatttgcaaaccacacatgtgataagggattaatattcaaaatgtacacacagcgtaaatgcaagaaaagaatctgatgtaaaaatggcccttccaacatctagcattattgtgtgttgaataaatacttgttcgattaggtctaatcactcttcatgattggatttccaaaatgtggactctcagtcacaatgagaggttgttttatcataaataaatcaataaatggcagattatacaccggagttactgagaattat

SEQ ID NO: 46845 - DNA, 632 bp, Homo sapiens
ctgccgacccgggtccgggggcccagttggcgcccggaccagctctccggtccgcgtcctgtagatgggaaaactgaggcctgagagggcgcgagggcggggacgaggccgaggactcgggttcgaatctcgaggacgccagtagcccgctctgaggccgcgtggggctggtggaggagccaccggtcgggcccccaagaccggctgacgtgggcctcgcctcgggcgactcccgccgggctagtggctggccgtgtggtgaccttgggcgagttacttcgcacagccacccaggggcctcttctccaacacgatagcactgcacccggagggccttcagacctgagctgaaatctacaccaccggctctctgactatcaggctttggactatactttgggctttcctgggtctcttacctggcagacagcagattttggaacttttcagcctccataatcatttcccagaagaaccacaaagcataaatttccccaaaaggggaattttgttgatggctttagtctattccctcctaaaagaccagctacaaccaaatgaagtgaacataacctcaagggtgtattgtcttcataataaaagatgaagcttagaactggaaaaaaaaaaac

SEQ ID NO: 46846 - DNA, 354 bp, Homo sapiens
tacaagtcattccccacctcggccctcagtttctgcttccaacgacctaagagcccctgaactcaggaaatctgtgaataaatatttgttgaatgcatgagtaaaatgcacgaatgaatgggagtctaaccagaagtggattttccagtcactattttgttgtgtttttctctttttttccttagttcccagaagaaccacaaagcataaatttccccaaaaggggaattttgttgatggctttagtctattccctcctaaaagaccagctacaaccaaatgaagtgaacataacctcaagggtgtattgtcttcataataaaagatgaagcttagaactggaaaaaaaaaaac

SEQ ID NO: 46847 - DNA, 433 bp, Homo sapiens
ctgccgacccgggtccgggggcccagttggcgcccggaccagctctccggtccgcgtcctgtagatgggaaaactgaggcctgagagggcgcgagggcggggacgaggccgaggactcgggttcgaatctcgaggacgccagtagcccgctctgaggccgcgtggggctggtggaggagccaccggtcgggcccccaagaccggctgacgtgggcctcgcctcgggcgactcccgccgggctagtggctggccgtgtggtgaccttgggcgagttacttcgcacagccacccaggggcctcttctccaacacgatagcactgcacccggaggctgcataatatttcattgtatggataaactacacagttcccagtgatgaagaccaagattgttcccaatctgtttgctattataaacagtgttgcaacaaa

SEQ ID NO: 46848 - DNA, 501 bp, Homo sapiens
ctgccgacccgggtccgggggcccagttggcgcccggaccagctctccggtccgcgtcctgtagatgggaaaactgaggcctgagagggcgcgagggcggggacgaggccgaggactcgggttcgaatctcgaggacgccagtagcccgctctgaggccgcgtggggctggtggaggagccaccggtcgggcccccaagaccggctgacgtgggcctcgcctcgggcgactcccgccgggctagtggctggccgtgtggtgaccttgggcgagttacttcgcacagccacccaggggcctcttctccaacacgatagcactgcacccggaggttcccagaagaaccacaaagcataaatttccccaaaaggggaattttgttgatggctttagtctattccctcctaaaagaccagctacaaccaaatgaagtgaacataacctcaagggtgtattgtcttcataataaaagatgaagcttagaactggaaaaaaaaaaac

SEQ ID NO: 46849 - DNA, 900 bp, Homo sapiens
ctgccgacccgggtccgggggcccagttggcgcccggaccagctctccggtccgcgtcctgtagatgggaaaactgaggcctgagagggcgcgagggcggggacgaggccgaggactcgggttcgaatctcgaggacgccagtagcccgctctgaggccgcgtggggctggtggaggagccaccggtcgggcccccaagaccggctgacgtgggcctcgcctcgggcgactcccgccgggctagtggctggccgtgtggtgaccttgggcgagttacttcgcacagccacccaggggcctcttctccaacacgatagcactgcacccggagggccttcagacctgagctgaaatctacaccaccggctctctgactatcaggctttggactatactttgggctttcctgggtctcttacctggcagacagcagattttggaacttttcagcctccataatcatcaactctgtgagggattgttatctccattttatggatgaggaagctgactctgagagatgactttccaaattcatccaactggaagaaaaaggaagtctctggggacttgaatccagaactgtccagctccaagtccagggctcactctattaagccactccatgaggaatgagtccctaaggaggccacagaaggccctaagccctcttttgttctctggaagagagtgccatttcttggcccttcccaaggccttgacaactgaagttcccagaagaaccacaaagcataaatttccccaaaaggggaattttgttgatggctttagtctattccctcctaaaagaccagctacaaccaaatgaagtgaacataacctcaagggtgtattgtcttcataataaaagatgaagcttagaactggaaaaaaaaaaac

SEQ ID NO: 46850 - DNA, 408 bp, Homo sapiens
ccagcccaaatttttttaagactagattcttcatgtcaaaagacaaagctagaacgaatggatagaggttatatggagaaatatttttgtagatggaaaacttgctaaaaacgaagttcttagtcacagaatttcaagaaactaaaagagatgttatagaaactaaactagggatgttgtagagggggttcatacatagggtagtctggactagagaaaccaagggataaaagaggattagctgactcaggataacatttcaggtttgtgaagatgaatttgtcctttgaaacagatctttttagaaaggttgtttcataatttctgaccgaagtatttgttacacgtaaaataagtaagaacggactgaggccagaaagctgtggatgacagaagggattggtgcat

SEQ ID NO: 46851 - DNA, 269 bp, Homo sapiens
tgtcctaattcctaagagaagaacaggaaaatcctaaattattgctctttctccctgtagactccagagagtgaatcctacagggtactataggaggtagggtattacaggaaagtacctagagagagagaaatgaagatattaagattgacgctctcaaataatttgggatgaaagaccagacttcaaaaactatgcctttaagctcttgcatattttatgaaaagtttgaaggttacacaactgcctagacttgtattttaaaaggg

SEQ ID NO: 46852 - DNA, 256 bp, Homo sapiens
ccctcttgctgttcgacttttctctctgttggcctcattcaaggccgacttactgtcctcactggggtggggggtggtctgtcagttcctcccaggtccctgggcctgctcagcagccttccgaaagaggccacctctttcttgctagctttggcaaaaacactgagattcattctcaagggctgactgcggttcatgctttgttgttgttgtttttctttttttgagcctgggcgacagagtgagattctgtctc

SEQ ID NO: 46853 - DNA, 622 bp, Homo sapiens
gggcatgtgagtataatgaataataatgaattctcaaaacagtcaaatgaagataactatatatagcgtcatcaattcatttataagacatagagctagatgagacttggagaccaatccccaaggacctaatttacctctttattttagagaggaaacatctgagactgagacagcttacacatctggttagtggccagttcatattttagtccgcttctttatgttgcaaagaacaacctctcacttggacaagcttaagaaacagggttatcaatggaacatgtgtcatgatggaagaaactgtcacatgtctggacctcagagacacagcactgaagaggggctgggaccagagagagccaagaactctagcagcaggagttcctggaactttagtatcccagcagtatacattattctcagtgtctgcttctctttgcctaataccaaattctcacctctcctctgtttgtcttacagccttttagcctttgctaactggtaatttgtgctttcacataaattaggcttgttgggactctagtaatctctcttcactttcaatacacattatggacatttttcttctatttttaaatttaattctccccccgcaaaa

SEQ ID NO: 46854 - DNA, 1243 bp, Homo sapiens
ctcctctccaggcccattcgtcaaagaatttataacagcttcagtggattttacctgcttttctactttctataaatggaatcacagggtattgtggtagatggaccacagatttcttccattcctgtatgcatgaccctttgcaatgtgacttctactcagggagaggtagggtctattttcacacccttgaatctaggctggccttttgacttatggggtgaccaatagaatgcagagaaatggacacgatgaagctcctgaggctgggccttgcaactcttgatagttacaacccttagttttaaaactttgcagcttctactttcactctcttgaaatgctgcccccagactgccgtgtaaggaaggtggtctaggccacctgggaaagaactgagcatcaccagaatgaggtcacgtgagggtacctcagaccttcccacccagccaaatctgcatctgagtgcagccttatgactcaactaaggtgaaatcagaagagaaattgcacagctatcccatcttctcatgagaagtaatctatctgttgttttaagacattaagttttgggatctatacttgttatgcagcgaaacaagtatagattagtgaaacaagtatgtactcttattttggtcaggcttctgttgctcaacacgtttgtaagattgttccatattgctgcatgtagttgaataccattcgctctcattgctgtatcctattccattgtatgaaaatattgtaatttatccatttaattactgatggacatttgggggtagtttctagtttgggacccttacaaatagttctgctatgaacatcttaataacatgtcttctggtgaaacatcccacaatacctgtgtttattacataaatagccagaggacttgctgggccgtacataggggaattcacatgatcagttttagtatatactgtcaattttcccaaagaggttgtaccaatttacttcccagcagctgtgcagaagcattagtagagtttcagttgttccacgcccttgtcaacgctttgtgcccttgacctttacaacactccattttaaagatgagtgtgtagatgttgaaaagtgcacaaggggaatgtttgctccatgagccaatcacggaaggaagctgggccagctggttttggcatctaccttctccctgacagctccagggaagaggccagactttaacaataaaaacttctatgtgtaaaaaaaaaaa

SEQ ID NO: 46855 - DNA, 315 bp, Homo sapiens
ttactaagcactcatgatggtgagggttagccataaaaagatgaacatagaggagctcaaaaactgagttttggtgggctggatagtaaatgaacctgtcatatgcttcagaggaaggtagtctctaaaacagaagtacaatgtagtgccatggaaacaagagtaataaattgtgctaagcattaaggaataaacaggatttaggtaaggagcttccagaatgtggggaaacaaccacaacaaatctaaataaaggcacagcatgagtgtgagctgaaaatgaggcattcaaggtagagtccagcaaagtgaagt

SEQ ID NO: 46856 - DNA, 270 bp, Homo sapiens
ccctctgacctacttctccccgacgccagttttaaatactgaccatataccatgactcccaggcccgaatcctggacctactgcctgacctctgcctcacctaaatcctacatccccacataacatccaacagaaatttctatcttaacatgtatcaagagagctccggatttccttctccacctcagtcagccatggtaccaccatccccgagctgctcccagtggaaccctaagtgcacttcttgatgccgctcccccaaccccacac

SEQ ID NO: 46857 - DNA, 485 bp, Homo sapiens
ggagacttctatgtgccctctggtgcaagggcaaaaagggactaataagctatgttggggctttttgataaggaaactgatcgcactcgtagggatggaaccctcatgacctaatcacccgccaaaagccccacttcttaataccatcatcttggttaggtttcaacatacaaattttggggggacgtaaacattcagacgatagcagtggcacttgaaaaatgctcctgaagggcggttgctgcccctggctgagagctgctgaactagatgcaccccttgttgagggcggggaccatggtctcgtttccatacctggagtggctggcatcgtacctggcgtggtgtaggaacctgataaacgtgtcttccatgaaaaaaggcagcctctcgggcactaagatgatgtcattgtgaagaacccctgcttcagggaagagtcagatttgtgtgcctctgttacaccgagcagggtggcacctgct

SEQ ID NO: 46858 - DNA, 385 bp, Homo sapiens
tttattggggaagcctctggaccaggacagatgcttctttgtctaggttttcacttgcgactccatccttccccgctaagagtcttgcttctacctctgggctcttgttgttgagaactttccatccctttaggtggccctattggatggcatctaacattaagtgtttcttttcattttaactactactatctagccaactagagaccagccacatgcaggtttagctttatcaggagaagccaggcaccagtctttgtgtctgtaaatttgaggaaacatccaactctctcattatctcctggaagtccccctactaggctgaggtaaggggagtgcaccccgaaacttcatccctttgggagggtggtgacttacagaacca

SEQ ID NO: 46859 - DNA, 298 bp, Homo sapiens
acatcctaaaaggagctgcctgtgtctgagcaggacccagtgttgtcatcaggtgtgccccgtgggagtggacagggattgaggcaacctgctcaggtgagggtcccccacttcaggagaggccttagcatgtgggctgagcaatgtggagatgaacttgggaattcatttgtctcatgctgaggaaggttgcatcttttcagagggtgctgaaaggctctggacatacatatatatatatatatatatattttttttttttttttgagatggagtttcactcttgttgtccaggctg

SEQ ID NO: 46860 - DNA, 416 bp, Homo sapiens
atcccaaggccaaccccggggtaggcaggctgagacaggccttgggacccaaaccccaaatcctacccccaccaattccttccctctctacttccttctccttccccaatcaaggatgtggctgttgcaggaggaacaggggtagagatacatttctaagtgaggaaagggctgatactggtttctcaggcacaagcatatggatgcagctaagtcaagactgctaattctctccaagatggtcccacccatggcctcccctataatccggagcttcctgttgtcagtctcttctgaaatcaaaacctctgagctgaaaaccatctgccttatgcccccaggggtgccactggagcccctaggggtgccattggagaaataaactgaaaccccatatgctcacagtctatttctct

SEQ ID NO: 46861 - DNA, 343 bp, Homo sapiens
tatgtttacatgagcatggcatattagcattaataggaaaccagaatcttcacagctttcatccattctttccacaaataacttaccgagtgcctccgatctgtaagactattccagatggtgggaaccaaaaaaatgccagttcctatgtgtataacacactgatttcattttcttcatttctaaaatgcctagtgacagttttcactaaaacctattcatagaaaactaaatggacttaatatttttaaaatcctctgattgcatggtttttgttctttttactatatataactatgtcatgtttcaccacctcctaggtagtaagttacttcctatattg

SEQ ID NO: 46862 - DNA, 500 bp, Homo sapiens
ggtctctttgagcttaagaaagctatggactatctttccttcaaatgcacatcacatgtctgtgaacactcaaaatgctcatagaatttcagggccctcagacggccagcttccacccctgtaccccctcaggggctaatgaacccaagtcaaaaggctgctctaaagttgttctgataatgtgttttgaaatgaggaagtgattaggcctccactagagatacttttgagatgatgcttaccaccttctgacctggaatcatttttataacttaaagactttatgtaatttagtagcaggttagggaatagaaaccacactaatctgaaggaataacaagatgatcaacactgaatcttcatgacagtaagattttctttccttggaggtatgagggtgtgtgtgtgtgtgtgtgtgtgtgtgtgtgtttgtgtgtgtgtgtgtgtgtgcctggcggttatttgggggcaaggtaccagattatttgcagtgagccaaa

SEQ ID NO: 46863 - DNA, 315 bp, Homo sapiens
gaatccagatgataaagatgaaacaaccttcatatttattcagaaggatttttttctgctgaagtttcagtatcaaatcaatacattccagaccctgatctccaagagtatatctcccacagtggtcaattcagggcagagaaatactgatcttcaaaagatccagtatttaaatttagctgagcatctggcaagcctggttcttccagagagaagaacctgagagtcatcctgttagtggtctttggggaaacaataccaggaggaaaccatgcccgggattatcctctctacctgctgagaagcaaccagggt

SEQ ID NO: 46864 - DNA, 520 bp, Homo sapiens
  misc_feature (512)..(520): n is a, c, g, or t
ggaaatcagtgcccagacatcaaagctagaaatgaaacatggtcagcaggagccttgcatgggcttctcttttgctggagcaagccaaaataataggaacggttttacattcctagtgccaggacccatctcgggtcgacaaaatctgaagacaagttaagggaacaggcagctgtttgaatagatcaattggatagtctaaggcagctctctggaccaagctgtaaaggagatacaatcgaaataatcactccggtaccacagtagacaggccttgaaggcactgggccccttttaatcggacttagcaagcattttttttgcctctgaccttctccttggaacaaaattagttaccagtagacttaggtgattgctgtactgcatgtaggcacataaccccaacctatataaacagtaagaaaattgtagcactttgagttggtctgctggaattatctccagccttctccctgtatccagttacagtgataaactcccttctttcctannnnnnnnn

SEQ ID NO: 46865 - DNA, 371 bp, Homo sapiens
tcctaagagcctgttaactttttgagcttttgtgttgacttttgtcatgttgttgaatgattttcgaacaaaagtttcttgtttctgtatatgctagatttgctaataaccattatttcttgtagctatgctttaattgctgtcataccaaattaagactataatcatttcttgtcttgggtacctaagacttatgcttatatgtcagtataacgattagtctcttcacaaatttgggcctcagatgaagaaaaataaaattgttaagatatactttacacccaaactatcttcagtgcttcttgattaaccgctatgcagcactactgagcaaggaggacattaggtgtaactagatacatagcatattc

SEQ ID NO: 46866 - DNA, 356 bp, Homo sapiens
aagtggtttatttagctcattattctagaggctggaaagtccaagacggggcagcccatctggtcagcttctggtgagtgtctcatgttgcatcataacatggtggagaaacagaagggaaagcaggcatggaaaggggataaaacacaggcgtgacctcaccttataacaacctgttttcctttgagaactaatccagtcttgtggaattaacctagtctcatgagaaagacattaatctatgtgattgacctaatcatctcttaaagactttacctccccacattgttatattggcagttaaatttcaacacgaattttggtgcagacacacagcaaaccatagcatttagtgc

SEQ ID NO: 46867 - DNA, 344 bp, Homo sapiens
ttttcttcataaagggctagccttccttttcattgctccccagctaaagatgtatcttgttccctccctgctctggtagctggggagatttgcagacctacagcaggtcaagaaaaaataagacatacatttgtaagccggattcgggctgccaagggaaaggtatattcatcacccggacagtgaaagaaatcaaaccaggggaggatatgatctgtcagctgtatatttcaaaggtacttcctcattgtgattatttatttatcacccacagcaaccgcggactttagctccactggacagaatgtgaaatgaggggatggagggtgaaggtggaggtggag

SEQ ID NO: 46868 - DNA, 578 bp, Homo sapiens
acttgttctggcaagtgtgtctctgtcttgctgctttcctttttctcttttccagatgattggtgatcaatctatccagctgccggtatgagagtgtgcgcagggctgcccaacagtacggctttagagagggaggggaagacgatgactggactctctattggacagattactcagtgtcactggagcgggtgatggaaatgaaaagttaccagaagatcaatcacttccccgggatgagtgaaatctgccggaaggacttgctggccaggaacatgagccgcatgttaaagatgttccctaaagatttccgctttttccctaggacctggtgtcttcctgctgactggggagatttgcagacctacagcaggtcaagaaaaaataagacatacatttgtaagccggattcgggctgccaagggaaaggtatattcatcacccggacagtgaaagaaatcaaaccaggggaggatatgatctgtcagctgtatatttcaaagccctttatcattgatgggtttaagtttgacctacggatttatgtactggtgacatcctgtgaccctctcaggatt

SEQ ID NO: 46869 - DNA, 585 bp, Homo sapiens
actcaacacagaacacttctgtgaccagatgtgtgggttttttttttcttcactcaccaagcaattctcccactctctgaacactagctggaggtcccgtaattcatttcggttctgacatgacctacctggagatagcatcacatcccacaggttaagggcacagtcccacaatactgctcccacttcagatgccaattgcaagtcccaggttatgacctttgcttctgaccgaccggctataaatcagggttcccatcataccccttccttggtttcaataatttgctaggatggcttacagaactcaaggaaacacttcagtttactggtttaatataaaggatacacagacagccagatgaagggatgcacattgcaaggtttggggaaggggagtgaagcttccttgccctctccaggtgcatgaccccccaggcacctccacatgttcagcaacctggaagcttgagcctgtaatcccagctacttgggagactgaggcatgagaatcaattaaacctgggagcagaggctgcagtgagccgagatctcaccactgcagcctgggcgacagagcgagac

SEQ ID NO: 46870 - DNA, 560 bp, Homo sapiens
ccaacacactataaactttcaaggagagaggctgtgtcttcttcatgtttatatctgctgcaacactgagttcatggcttttcacacataattgctcaacagagcaggtgccatggaaagtcaattcaatgagtaaaattacctcaaaatagtccgttaattcactcacctttgatgtagacagattattctgcattgatacttatctcttactcttaaaattcgctatgtattaataaatattttattgaatattaaggaatgatcactattttaataagatgttctttaccatatatttctatatgtacatgataattagaagtatcaaattatattgtggaatgtaaaagcttttcttctgaagccaagcatttgttttattgtcatttcagtggcaaatatggacttcatattcaaaatgatgttctatattatttttccttacaagctttttgaaaaacaatttaataattccatgattgttgtagcaccactgaattgattctgaaagcttactttttaaataaaaattgacctttatcaagcattccttgagg

SEQ ID NO: 46871 - DNA, 690 bp, Homo sapiens
agatttaggaggtggaggcatcaggttttctggaagtagggagaaaatcagaggctaaagagtttgaaaatgtgcacagaacagtttgagctcaaaatgccactcctaccttattttgccaggtgattatcaattcaccacaattcccacaggaaatgagaggcattatcttttgccaaatagaacttgataggctattaacttgggtaccctgggcctggaggaggatggaaataagatagaagactaaaaacaggatactaagtggaagtctgaataaaaggggatgaactcccaactcctattcccacccatgtggcgtgcctctgcctgctcgccagtaatggtagccaggcttatatcccccatgctgactagaacatccttctctggggaaattaaagagcagacctctggagaaattacacttctcaaagaaaaattaacaggcactgacatttagggtcccaaaggcaaaaagtaggtcacactcaaagcatctaactcaaagaccctggacttcagttgtagaccctgagcagattagactttggattgtctcccttgggtaaaatacagtggtctccccttattcaaagtttcactttccgtggtttcagttaccctcaatcttggccccaaaattttaaatagaaaattccagaaataaaaaattccagtatgttctga

SEQ ID NO: 46872 - DNA, 357 bp, Homo sapiens
attcaagtcctttacctacttaaaacattgggttaggttgtggtgtggctgtctgctgggatggtattgcatcaaatccataaatcaataggcagaattaaaatgttagtattgagtattctaatccatcaatatggcatatttctccatttattcaaatcgttaatttttatcagcaaggttttgagacttttagtgtagagatcttacatatcttttcaaaagttatctcacactattatgaatgaagttgctgttttaaaaacattttatttctggccaggtgttgtgcctcacacctgtaatccgagcactttgggaagccaaggtgggtctctataaaagtaaaaagaaaaa

SEQ ID NO: 46873 - DNA, 868 bp, Homo sapiens
gtggggctcaagtccagcaggagcaggagtttggagccaggacttcctagcctctcagggtttttttttaacttccttacctgaaatgatttgtgctatataacttgtcctggctaaactttcttaatctcaactgtttcatttaatcaataacaactactgcgccaccttcataatatcaattttcagcatttcatttactgaatatcatttcctttccttccagactattctactgtgtcaaattcaatattcctttgactcaataggatctccaatccagtgaccccattatttgtttgtttattaggacaagaaaaacaaactttcccagaaactccccagtagactgctcctcatatctcgttggctagaactgagttgcgtgcccattcctaaaacaaaactggcaagaaagatagttaccaagattggttcagaccaaatcaggattttttcctgaggagaggataaagtgagcttcccgggaggcaaatatttacacattccaaagattccaaagaaaaaaagagaataaatactgggtcgttaactaatagtaagtggtacggtattacaggtaaaatttatccttttagccctagcaacaagtgacaccttctgaagccattattcatttgtcaggaatagggcaagtatcaggaaaagaaacaccgaaataaactctgtttccatttattgcattctagcactggttctaccaaatatttgttggatgactttaggtaaagcatctagcctctctgtcttgattgccacacccacaatatgagataaatattattctgcatacttcctgggagagctgggaagataaaatcagatcattataccacataaagcaaag

SEQ ID NO: 46874 - DNA, 286 bp, Homo sapiens
caactcttaagtaaatgtgaagttgttagaggacactgtttcctccttaatcctttaaatacttgaatgtggttcatagttttgtccccaaatgctcttggatatgttcaagtctcctaggtcctctgctgctcctttagaaaccctctgtttcaaccatactggtgtaagcagatttttttttctgtctgatctcctctaaagaggctattgtgagtcttgccctgctaagcttgagatcactgtggagatacagagatgggcagacaaggaacaagcgaggagg

SEQ ID NO: 46875 - DNA, 338 bp, Homo sapiens
gaatttcataaatttcttgttttaccgagttttattggtctcattttagtgggacaaaaaacaaattaacctttcatgttttcacttgttacattgtagagagaccctgaattgttgggacgaaaaagggaaatgcttttcttggaccaattttttgattggtccacttgctgagataagcctcctgctgaatcaaatgtatgtttttgtgtttggtcttggatcttatctgcctgcagcagcagcaagcttaatagcaaatgaggttcaaaaagatgaagcagctatttcagcctcttatcctaatgttttcaaagagctctgtagatttggtcatt

SEQ ID NO: 46876 - DNA, 413 bp, Homo sapiens
ggcctctccagcctcggaagagctgcagtccttatcggctatcactggctctgcctgcatttgccggctctcttgagtcacgtgcatcccagcaccccgcctgggctcggactgtgggaccagactcagcctccccgaacacaagggaagataaggcttccatttgctctgtgtttcaccctctcctctgtctctccaggccacacatggaacggggcggtatgaggaagagtctgaaagtggtgaagagtgcacctatggccctctgacctccagccagagcagggcctaggggaggcttagagaggccagggcctctccccgtggttgaagctcccatttatttaagaaaaagtggggggtggggaaaacgttatgttaaatgtttacatggaaccaatgaacaactttaa

SEQ ID NO: 46877 - DNA, 283 bp, Homo sapiens
  misc_feature (281)..(283): n is a, c, g, or t
caagactccatctcaagaaaaaaaaaaaaattagctgggtgtggtggcacatgcctgtagtcccagctacttgggaggctgaggtgaaaggatcgcttgggcctgggaagcggtgattgcaacgctgcacatcagcctgggtgaccaagcgggactctgtctcagaacaaaacaaaacaaaaatacatattcccagatcctggaatgtcctgggaagctatatgtgtgtcatgccctcccagctgcacctgaacaatgagcatagcaaacatcaaaaaaannn

SEQ ID NO: 46878 - DNA, 805 bp, Homo sapiens
tcatgcctgtgatcccagctacaaaggaggctgaggcaagaggatcagttgagcccaagagatggaggctgcagtgagctgtgatcgagtcactgcactccagcctgggcgacagagtgagactctgtctcaaaaaaagagaggaaaaaaagaaaatttaagtaacttctgtttagaatcctaaatattggagatgccaaagaattctgcagtaagtgttagaaacagtcgggaggacagtatgattattatcctcaacctgtggattatctcttcaggtttttcaagaaacactgagtctgtgtttttgatggggagaagaaactattaattaaatgcccattttgtgccagttaccatgctaaagattaatgtctgtcttcagaaatagcacagtatttgggccctggttgtggtaattctttttgagatggggaaactgaggtgcagagattttgctacttttgtatttgcaaagttgacaacctgtttcagaataccaaggttatcagaactttcttcatgtgtttctcagtccttttaatgccctttaaaaacagattatcatctcattttttgctaagcttactgttaattttattttagtggaataagaatatggatacctgtctttaagaagagagtaagcaagtaaacctagggaaagtatcaggttgtagaaccacataccgatgatccttgccaaaatcctggcataggaatttgaaccctggtgtatgaaaagtctgccctttgcatactcaggtttcgcatcccgtgaatgctgtatttttgatccgagtac

SEQ ID NO: 46879 - DNA, 632 bp, Homo sapiens
  misc_feature (2)..(2): n is a, c, g, or t
  misc_feature (294)..(294): n is a, c, g, or t
cngcactcagagatccagcaggtgctgcaccatgagtgtctctgtgctgagccccagcagactcctgggtgatgtctctggaatcctccaagcggcctccctgctcattctgcttctgctgctgatcaaggcagttcagctctacctgcacaggcagtggctgctcaaagccctccagcagttcccgtgccctccctcccactggctcttcgggcacatccaggagctccaacaggaccaggagctacaacggattcagaaatgggtggagacattcccaagtgcctgtcctcnattggctatggggaggcaaagttcgtgtccagctctatgaccctacctgcttgtctacctgtctcctacccacctgtatctcttgttgggagcactttagaagggtaaacctcctaagtctttgagaagataaggcttggctactgttaacatatataaatcaataatagaaatcaaatacagtaaactagcatatagtctacgaatagaatgggagaatagtaaagctgtaggttgaactgatttgaaaacaggaaagaggaactattggcgttgataaaattaaatcttcgctcacccagttttggtaaataaaagtcgtaaaagtgagagatcat

SEQ ID NO: 46880 - DNA, 2868 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46881 - DNA, 2745 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46882 - DNA, 2924 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcaggtgagagcggacgcggcctcccctgtttcccaggcggaccccttgaggcacagcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46883 - DNA, 3351 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcctttctgcactctgtgtgctcgatacagaaggcaggtgtgctggccttcagagccaggtgccctgctcccctcgtgtaaggaagcgcataaggttgtgaaggtcactgacccgagagcgctgcgtgctgaccccacacttcactggggagccctcttgggtagcgcgagacgcctacccgcccagggccaggtcagtctcccaggctccgtgtcttcacggttaccagggcacgccactcaatctggatgtgagccggggtggatgaggttctgaagggcacaccagcactgggagcgggggcagtgggggtcttattctccagacgcttcctctatctagttgtaacaaacgtcaaagaatgtcaggtcttgtttctgcagagcagactttggcctgacggggtccacagacctgtttcacttgcaacacccagtaaatgtgttactgggtgccctactttaaaaatcagagatttcaaatga

SEQ ID NO: 46884 - DNA, 2534 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46885 - DNA, 750 bp, Homo sapiens
cggcacgagggaaaggaggtttgagatcagggttgggcccatacagattgtgtgagctggtctcaagtacaaatactcatctgaggctcctgaacaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46886 - DNA, 2751 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcctttctgcactctgtgtgctcgatacagaaggcaggtgtgctggccttcagagccaggtgccctgctcccctcgtgtaaggaagcgcataaggttgtgaaggtcactgacccgagagcgctgcgtgctgaccccacacttcactggggagccctcttgggtagcgcgagacgcctacccgcccagggccaggtcagtctcccaggctccgtgtcttcacggttaccagggcacgccactcaatctggatgtgagccggggtggatgaggttctgaagggcacaccagcactgggagcgggggcagtgggggtcttattctccagacgcttcctctatctagttgtaacaaacgtcaaagaatgtcaggtcttgtttctgcagagcagactttggcctgacggggtccacagacctgtttcacttgcaacacccagtaaatgtgttactgggtgccctactttaaaaatcagagatttcaaatga

SEQ ID NO: 46887 - DNA, 2788 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46888 - DNA, 1621 bp, Homo sapiens
gcagatgagacgcctacccccaggaccacccaaactgttccttggctgaggctgtcatagcccaaaggtcaccgtgtccttggagccaaggccccagtgggaggaatgagaaccgcttttgtttggaggggcagtcacgaggcgcatgaggcagccgcccagccctcaccgccctccgtctgtctgtccgtctgtctggcccaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccgctgcattcccagagatcaagcagcccggtgccgtggccagtgaactcagaggtgctggtggacgggctaggactttggggttaggccatggggctctttctctgaaggccactttcctgacgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46889 - DNA, 2267 bp, Homo sapiens
ggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaacatgataaggaattggctgactatttttatcctttttcccctgaagctcgtagagaaatgtgagtcaagcgtcagcctcactgttcctcctgtcgtaaagctggagaacggcagctcgaccaacgtcagcctcaccctgcggccaccattaaatgcaaccctggtgatcacttttgaaatcacatttcgttccaaaaatattactatccttgagctccccgatgaagttgtggtgcctcctggagtgacaaactcctcttttcaagtgacatctcaaaatgttggacaacttactgtttatctacatggaaatcactccaatcagaccggcccgaggatacgctttcttgtgatccgcagcagcgccattagcatcataaaccaggtgattggctggatctactttgtggcctggtccatctccttctaccctcaggtgatcatgaattggaggcggaaaagtgtcattggtctgagcttcgacttcgtggctctgaacctgacgggcttcgtggcctacagtgtattcaacatcggcctcctctgggtgccctacatcaaggagcagtttctcctcaaataccccaacggagtgaaccccgtgaacagcaacgacgtcttcttcagcctgcacgcggttgtcctcacgctgatcatcatcgtgcagtgctgcctgtatgagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggcctacatgaacttttactacaaaagcactgagggctggagcattggcaacgtgctcctggacttcaccgggggcagcttcagcctcctgcagatgttcctccagtcctacaacaacgaccagtggacgctgatcttcggagacccaaccaagtttggactcggggtcttctccatcgtactctctgtacataactcagcgtccgtgactgcagtaacagccagccctacccagagtatttctgagccatgaggggcccaccagattggttctgaattggattcatgcccagcgcattagcatagtaactcctttcagattttttggagggacgtttggaagtggcttactctcttctgccctctctcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcc

SEQ ID NO: 46890 - DNA, 309 bp, Homo sapiens
acaggcacatgccagcatgcccagctattttttgtatttttagtagagacagggtttcaccatgttggtcaggctggtctcgaatttctgacctcgtgatctgcccaccttggcctcccaaagtgctgggattacaggcgtgagccactgtgccaggcctcatttttcttatttaaaagatgtatagcctaatagtgagtgtaaggtacatcattgtagatttaatatgcattaacataatgatgaatgatgttgagcgtattttcatggtcttattgattatttatatcttttggtaaaagttttatt

SEQ ID NO: 46891 - DNA, 447 bp, Homo sapiens
cttaactctaccccttactagtcttgctactttgaaaaagctgcttaatcttcctctgcctcagctgcaaactatgtaatactgcttttatggggattaaatgaattaatacacttaaagcattgggagtagtgcttagtaaataataaataactctttaagggtttgctgttaatattaccagtttcacagcacatattgcaatcagttattatcttgtatattttgtctctgcactagaatgtaagcattttaggttctaggatcccatctgcttggttcactcatgtatccctattacctagaacagtgctctgtacatagtatccagtctggagattgagtgaatggaatatcttttctccttttcagctttcaccttttgattctttgtctaaaccctagtcactttccatcaaaactttcattttggttgctagaacaggg

SEQ ID NO: 46892 - DNA, 400 bp, Homo sapiens
aaacacttctgtcctgatgacttgctgatgttaggtttatagttaaccataagtgggtaaacggtttgctgatagtcatacagggagaaagtaccatggctccatgccttgagttccagggtgaggacagaggccaggacatcagttgtttatatcccttactatccttgtactaatgttcgtgccatagtgcaaagaggactcacaacgtgcaccatttttatgcctaaataatgcatagaaactctacttcttcttctcttgaggtattctctgcaactcttgcttatctgttttattgtctgtaacactgggattagtgagagcttttctttgggagaaaagtctctacattagatttgtattcagagatgaggcttgtttttgttttgtgtgttca

SEQ ID NO: 46893 - DNA, 304 bp, Homo sapiens
ttctttaatccatctaatgggaaaaaacatagtacatcaaaaaatggtgctgcagcaaggggtggggtgacctgtactcgtgtaagtaaaatgaatgatattaccatacttcagttgatttgtgtaataaattcctatttgatttttctaagacattatacatttaaaaaacatatttcttatcagaccatatctgcttttacattctatatgttctaaattgccactcttcattccttttctttttgaagttgttagctaaactgcacaacaaatcaggtcccagatttcttgttaaacgatc

SEQ ID NO: 46894 - DNA, 1007 bp, Homo sapiens
tcccaaggtatatgatcattggtggcacctgctagctgctaggtcgtacttgctttatgctaatagagatttattaaagcacttgttaggctccacggagaatataaaaaggaaccaatgattgaattacttgttttaaatttcctagttcaactagaccattgattcttaacaagggcaattttgccctccaggggacttttggcaatcgtcacaactggggatgggggatgccactggcatctactgaatagaggacagggatgctgctgacaaacaatgcatgggatagccccctgacagcaaagaattatctggtccgaaatgtcattgagctaaggttgagaaactaagctagggagacaagccatgcatattaaaaacaaccgtagaagaacaaaagaagtgtctgtaatcaaaaactagaaagtagttgttcccagatcctgggctgttgatcaatgcctgtcttttgcaaagtttttatcagtcttttggtaaaatgacaaaaataaggataatgtagtgagtttttcctacagtcaaacttactcagtttgaacaatataattctgagagtcattcatacttcattcaactttaaatttttaaatgaaattgtgattatagtagatggtagttgctacttttggtgtcttggcaaaagttaatgattctgtggaggtttgtaaattgtatttatttttagaaattttactgattttggccgggcgcggtgcgccgcctgtaatcccagcactttgggaggcaaggcagacagatcacctgaggtcgggagttcgagaccagcctgaccaacgtggagaaaccccatctctactaaaaatacaaaattagccaggcgttgtggcacatgcctataatcccagctactcgggaggctgaggcaggagaattgcttgaacctgggaggcagaggttgcagtgagccgagatcgcaccattgcactccagcctaggcaacaagtgaaactctgtctcaaaaa

SEQ ID NO: 46895 - DNA, 451 bp, Homo sapiens
cctgggcaacatagccagacccatccctacaaaaattatgtttctaaagattgactcgccatagtggcatgtcacttcctgactcgtcccagctactcaggaagctgaaatcggaggatgacctgagctcaggaggtcgaggctatagtgagcaatgatcacatcactgcaccccagtttggatgacagagtgagaccctgtcttaaaaacaagcaaaacaaaacaaaaccaaaaccaaaaacaactagttaccagattctgaatgcctaacatacaagcatacaaggtggcaggatgagtacataaagtcgcaaaaagtactcaagtgcctattaaatgaaaagcaaacataccaggaaaaacttcagctcctgcttgaagaactaagaggggaattagtagaaaagctaaggacttagaagaaatgaagctgcaggtaattaactccaa

SEQ ID NO: 46896 - DNA, 435 bp, Homo sapiens
ccctggaattacaggcttgagtcaccacacctggcctaaaaactagtttttgcctttcctcaatattttttggaagtcaggttgtcagcccattgtctctactaggaaagaaaaaagttaggaaaagatcctggtggcaaggagccagagcaaagaggaggagggatagacagagtgagaccctgtcttaaaaacaagcaaaacaaaacaaaaccaaaaccaaaaacaactagttaccagattctgaatgcctaacatacaagcatacaaggtggcaggatgagtacataaagtcgcaaaaagtactcaagtgcctattaaatgaaaagcaaacataccaggaaaaacttcagctcctgcttgaagaactaagaggggaattagtagaaaagctaaggacttagaagaaatgaagctgcaggtaattaactccaa

SEQ ID NO: 46897 - DNA, 652 bp, Homo sapiens
caatgaacatacaccgtgcgcatcttaaagccacaccgccccatttcacgacttcactagacttctcgctactgccagtccctctgcagttcaaccccgtttaaaaaaaaaaataaagtgaagcaaatcaagggtttgcgggtcgggttcctaccgcagggaggaacgtaataacttggaaacgtaagaaaaacacattccactttccgaaaacaaaaatttttttaaataaaaagcctagttgtgtagacgtgtctggctccagaatccacctcaaagggtcgcgtgttttccccctccgcgggaagcgaatccccgggatgccttggtgacactggacgcggtgtcgggacgaatcctcgcgatccgcgcacagtttgttttgaatgaatccagcatcggggcatttataatctcctacgtcatactattattaaatataacatgcataccgagttttgtaaaaaaaaatactgactatataaacatctggttaataaaaaggggtgtacaaatgaacccaaaataatcaggaaaactttactctctcgaggaaacaattccgtttctctaagttgtaaaaaaagattctgttgtttctcttttacttatgtcacattcgagattcaaataaaaacgcctctgcctctac

SEQ ID NO: 46898 - DNA, 847 bp, Homo sapiens
attgaggcgctcctgcagcctcctcccggcacgggactcctcacaacccccagcctcagcttccctgacagggcaggggctcactcttccccactccgggccaggaacgcagcctgcttgccttttgtccaattgggtgctctttctttgcgactgatacaaagtgggaacaaactccgcttccggtgatgcccgggccccaggaggctgggggagaagtgcacgctgcccagccttcaacctgaactgcccccagcacttccgagccccgacccctgcagctgtgagggcccaggggctgctggctgccaggaccaccgcattgcagaggtctcccttgcagcaagagatctgggagtccacaacggcacttaacctgccctctgccctggcaccccagggactcactgccaaagacgctcactttctgggagacacagaccccatccaggaaggggcacgagaccacgctgcaggaggccccttccaagaccgccaagcatctgtagcagcgcagaccctgagctgggagagagggcaagaaaacacacccctggtggagatttaagatgctaatgacacatgcgacgtatgagcaagcaggtgcagctactgcacgtgtgcacccagaggacccccccagaacatgcttcctagcaacacctctgcccacccgctgattctctcggcaccacgggaaccaccttctctactctcactgaacacccctgggatgtatctgtaaaaattggaacacctttcggctagaaacccagaggaaggcgctcatgaccacccgggagctcaccagagggctcttgaagtttctattcaagaaaaccattcc

SEQ ID NO: 46899 - DNA, 805 bp, Homo sapiens
attgaggcgctcctgcagcctcctcccggcacgggactcctcacaacccccagcctcagcttccctgacagggcaggggctcactcttccccactccgggccaggaacgcagcctgcttgccttttgtccaattgggtgctctttctttgcgactgatacaaagtgggaacaaactccgcttccggtgatgcccgggccccaggaggctgggggagaagtgcacgctgcccagccttcaacctgaactgcccccagcacttccgagccccgacccctgcagctgtgagaaaacacacccctggtggagatttaagatgctaatgacacatgcgacgtatgagcaagcaggtgcagctactgcacgtgtgcacccagaggacccccccagaacatgcttcctagcaacacctctgcccacccgctgattctctcggcaccacgggaaccaccttctctactctcactgaacacccctgggatgtatctgtaaaaattggaacacctttcggctagaaatggaatcatgatatgttgcctggctggtcttgaactcctgagctcaagtgatcctcccacctcagcctctcaaagtactgggattacagtcatgagccactgtgtctggcacaagcaaatattaaaacaatgaaagtacaatggaatagaggtaggtaaatgaagttatgctgtgtaatgttctgaattgttcatgagtgtgggcggcaagccacccaggtgccgaggcaagagaccaagggcacaagctgttccagtataataaagaaaatatatagaataagaata

SEQ ID NO: 46900 - DNA, 621 bp, Homo sapiens
gccctcacagcagggcccagaggaagactgaccccaggctgagcaggagctgtacgcacagggcccaggggctgctggctgccaggaccaccgcattgcagaggtctcccttgcagcaagagatctgggagtccacaacggcacttaacctgccctctgccctggcaccccagggactcactgccaaagacgctcactttctgggagacacagaccccatccaggaaggggcacgagaccacgctgcaggaggccccttccaagaccgccaagcatctgtagcagcgcagaccctgagctgggagagagggcaagaaaacacacccctggtggagatttaagatgctaatgacacatgcgacgtatgagcaagcaggtgcagctactgcacgtgtgcacccagaggacccccccagaacatgcttcctagcaacacctctgcccacccgctgtgagtaatcatggaagactcccatggaggagcctccctggtgccagtctctgctgtctcgcccttacaagcagccggccctgaatcctctctctcagggcgtcctatctcttctgcatcaaactttcaaaatgttctttctcctttgcaatacattgctctgtgctgca

SEQ ID NO: 46901 - DNA, 763 bp, Homo sapiens
attgaggcgctcctgcagcctcctcccggcacgggactcctcacaacccccagcctcagcttccctgacagggcaggggctcactcttccccactccgggccaggaacgcagcctgcttgccttttgtccaattgggtgctctttctttgcgactgatacaaagtgggaacaaactccgcttccggtgatgcccgggccccaggaggctgggggagaagtgcacgctgcccagccttcaacctgaactgcccccagcacttccgagccccgacccctgcagctgtgagaacctgccctctgccctggcaccccagggactcactgccaaagacgctcactttctgggagacacagaccccatccaggaaggggcacgagaccacgctgcaggaggccccttccaagaccgccaagcatctgtagcagcgcagaccctgagctgggagagagggcaagaaaacacacccctggtggagatttaagatgctaatgacacatgcgacgtatgagcaagcaggtgcagctactgcacgtgtgcacccagaggacccccccagaacatgcttcctagcaacacctctgcccacccgctgtgagtaatcatggaagactcccatggaggagcctccctggtgccagtctctgctgtctcgcccttacaagcagccggccctgaatcctctctctcagggcgtcctatctcttctgcatcaaactttcaaaatgttctttctcctttgcaatacattgctctgtgctgca

SEQ ID NO: 46902 - DNA, 824 bp, Homo sapiens
tgttccctggagccacatggcaagagttctgccagaagagccatgagcctggcactctgtgggttctggtccctgggggggcacccgtgccccaggagcacctccccaaggccatggtgccagcaggatgttgcagaggcctgaggtcagagtggcaggtgggcggcctcaggaatggtgaggaagaagccgagtgctgacgctgagtgggtcagcaaagggctgtttgttgaccttgagagggaggccctcatcctgtgtgggaggccagcagggccccctgggaccacgttccctccttgcttggattcaggtagcccagagagctgaggggttggccctggctcctcggcaagttagtggcaagctggatggagctggggactcccgccctgggccacggtttctctatgaccctaggtcccaagcagccagtggtggggcctggtctctgaggcccagctctgaaaaaagtggtgttgttggggggcatgggctggagggcctgggcccagaggacaaggagtttaagcagggatatgttccctgacagggaagccccgacctctgccctggccacatccttcccctgatctcatggctgaaaagccacaccagaattcctgcaattcagtgaggcagctcttcaaaaccaagcagctggtgacgcacagggacagagggtaggcctgcgggggagagggcgggaaaggccctcacagcagggcccagaggaagactgaccccaggctgagcaggagctgtacgcacagggcccaggggctgctggctgccaggaccaccgcattgcagaggtctccctt

SEQ ID NO: 46903 - DNA, 1039 bp, Homo sapiens
attgaggcgctcctgcagcctcctcccggcacgggactcctcacaacccccagcctcagcttccctgacagggcaggggctcactcttccccactccgggccaggaacgcagcctgcttgccttttgtccaattgggtgctctttctttgcgactgatacaaagtgggaacaaactccgcttccggtgatgcccgggccccaggaggctgggggagaagtgcacgctgcccagccttcaacctgaactgcccccagcacttccgagccccgacccctgcagctgtgagggaagccccgacctctgccctggccacatccttcccctgatctcatggctgaaaagccacaccagaattcctgcaattcagtgaggcagctcttcaaaaccaagcagctggtgacgcacagggacagaggggcccaggggctgctggctgccaggaccaccgcattgcagaggtctcccttgcagcaagagatctgggagtccacaacggcacttgttcttccaggcaggtaactcactgaatgctcacagcctgcgcctctcctgcatggagctgaacctgccctctgccctggcaccccagggactcactgccaaagacgctcactttctgggagacacagaccccatccaggaaggggcacgagaccacgctgcaggaggccccttccaagaccgccaagcatctgtagcagcgcagaccctgagctgggagagagggcaagaaaacacacccctggtggagatttaagatgctaatgacacatgcgacgtatgagcaagcaggtgcagctactgcacgtgtgcacccagaggacccccccagaacatgcttcctagcaacacctctgcccacccgctgtgagtaatcatggaagactcccatggaggagcctccctggtgccagtctctgctgtctcgcccttacaagcagccggccctgaatcctctctctcagggcgtcctatctcttctgcatcaaactttcaaaatgttctttctcctttgcaatacattgctctgtgctgca

SEQ ID NO: 46904 - DNA, 317 bp, Homo sapiens
ggcctaacaatttagggttcattttacactgaccattttcatatctactcataattttttttagaagtcggtgtagaatattagtgtttcctgggatgattgactttttattgttttttatttttttaaataaatagagatggggtcttgctatgttgcccaagctggttttgaactcctaggctcaagcgatcctcctaccttagcctcccaaaatgctgcaattacaggcatgagccactgtgcctggccaggatgattgatttttcattattcaataccttttgtttatcactgctcagtagcgccattaaaat

SEQ ID NO: 46905 - DNA, 312 bp, Homo sapiens
gacgatggattggtggcggagtggatccaggggaatgtgtagaagaatattggcaaaccaagaggagatgatggtggcctggatgagggtagtggtcgtggaggaagaggatggaggtgaaatcaacagggcttggtgatggattggaaatgagtggaggatgctttgaactatagccaacagaaagccctattcaaactggtttaaaaaaataaagacttcaccaaaggctgaagaaacagactttgagttgaagtttcaggaataactcccgggactaggtcatcaagaaaactgctgtaatcagaaagc

SEQ ID NO: 46906 - DNA, 456 bp, Homo sapiens
gttgggcaaaagaaccaaaaaattaattattaactaaattaaattattataaaaattaattataatgtactgagtaagctaattatgagggtaacagcccacaagagtcccactgataagacttcataaatgccgtgacattggccacgcttcagtttctgagagcactgcaagtttatttcactccagctaagtgcttatgacgtgcatttttaaaaatgcaaatcatgcttcaggtcagcagaaaaatgcttccctgacttcccagtgagctttacatttttatagatgccagtcattaaataagaaagatatttaatgcaaagttatcccagatccagcattgtaagaagatgaacaaagaagaaggcaataatagaacacagcttagacagtgggtccttgaatgactttccactcaacagcatttctttgtaacattgatgagaaaaaaaa

SEQ ID NO: 46907 - DNA, 309 bp, Homo sapiens
ttgggtgtggagaacctcctccctagcccaagatgaccatttgattaagtcacatcccagagcagcaaactgaggacagggtcaggctctatccaaagagtccctggttacctccaaggacacttgcagtgaagtagaaagaaagggaacggaaaggaagggggacatgacacataaagccagagccctccctaccctcaggatggggaccaggcaatgactaccacgttagcttcataaccttaagccccttgaccatccacatcccaaggatgactctcccccaacccccaaggtatgaccttgacc

SEQ ID NO: 46908 - DNA, 378 bp, Homo sapiens
cactcaccgaaacctgcatggtgggtgtggtgaattatagcaaatacaacctgattatccttgaatttttatgagaatatcctttgaaatgtatgtccatgggcattttaggaagtatgcctaatccgtataataatgtagactttctttcctcagtgcttgctctcgtgcttctctaaactacagcccttgataaagattctcttgactgaaatacgttattctccccagagaaggatgctgtagtcacttattttaatataatggttttagaggtcaacagttctagacagatgccatatctggactgttttgtaaaacatctttaaatcagatctctattcatacatttgcaaataagtaaaagtttgtaattta

SEQ ID NO: 46909 - DNA, 440 bp, Homo sapiens
ctggtagtagaatcagcaaataccagctctctcaactatcctattcatcaactttcgatctgcctcactcacacctaacccttctttatcagatttctccacaggggcttcaggagttctcttttattagctgctgctgctctaatcagggtaaaaatctaaagcctcgaatgaggtttgccagggggtccaaaatctggcccagactctccaggcatttcctcaaatccaccactactccccacaccccaggcgcaataaattatgaaatacaaaaccaaggcaaagccaggccatgtattagccttcttccttaaagcaagccgactaaattgagatgtttcatagaatcttcccgcttctctcccttctcagcgcgtaaagaatgttctggcagagcacggtggctaaagcctgtaatcttgtgctttgggaggctg

SEQ ID NO: 46910 - DNA, 738 bp, Homo sapiens
attattctccccaatttaaagatgaagaaagtgaggtttaacgagttaaagatcatgctcaaggtcaccctggtaaatagcagactgaggattagaaagcctgggtttttggaactccacagcatgaagtcagtaatgccagcagctcctcagctctgatgtgctgtttgcacatggaccccagttgctcgccacctgcggagactctgctttaactaagcagtggactgaagtggcatgacctccccatccagctttgccctctgagaggacagagccctgctccaggatgcttctgtactctcggttttcctaggggaagtattcagactgaccatcctctgccgtttgagagccacggggtctgaggcagaaaaggaatgtaaaaagaaaggcaaatgcctgaaagaagtggagctaatttgaagttttggggatttgaaaatccagtctagggattaatagacatcttactttgacagtcctgattcccacttgcacgaaaccatttcactgcttggagcatgtcagtctaaaaggcaagagctgggcaaataagggaaatggaacccagtgactgttgctccccatgaatagctattatgaaaagtaagagagaggctgggaagagtggttcatgcctataatctcaacactttgggaggccaaggtgggaggattgattgaggccaggagtttgagaccagcttgggcaacatagtgagaccctgtctctac

SEQ ID NO: 46911 - DNA, 285 bp, Homo sapiens
ctacattctaggacactgactgggtggggtgcagtggttctggctccagtgagggtgcagcagcataacctccatccaggtctgtcagctgaggttggcattagcaaagagtgaagtggtcttctgcagccagtgctgtaggcttcagtagcagtgagggctgttggaatgttgtggtgaagtctactgatttcctcctgattttttattccaccatggaaattgtggccaaggaaatcccctcttggttctgagtccaacttatgggtgcttgcagtggcactg

SEQ ID NO: 46912 - DNA, 421 bp, Homo sapiens
gagatcctgtctcagatttaaaaaagaaaaaaagaaatactgatagtaaacaggatttttttatgattttcttgcatcttcactctcactatgcctattgcatactattcctcacctatgaataagcttgtgtctccagatactaataaaatttcacttgaatgttagacctctcttcttttgcccctaccacaatatacacttcaggaagcataccatcacattgctttgcttttttgaggcagggtcttgctatgtagcccagttgctcaggctggtcttgaactcctggacccaagcagtcctcctgagtagcagggattataggtatgtgccatcatgactagtcgagattgttttttaaaataatgttgattataagagtagtacatgtgtattatagaaaattagaaaatgagtc

SEQ ID NO: 46913 - DNA, 417 bp, Homo sapiens
gctccgtaatttcagctctttgagaggctgggatggatggatcacttgagcacaggagtttgagaccagcctgggcaacatggcaaaactccatctctacaaaaaatagaaaaattagctggatatagtggcacattcctgtagtcccagatactgaggaggcttaggtggaaggatcacctgagcccatagagattgaagccgcagtgagctgtgaccacaccactgtgctccagactggacaacagagtgagactctgtcaaaaaaaaagaaaagaaaagaaaaaaaaatcagagactgtcgactgaattaaaataaaaataagatccaactctgtgctctctacatacaaccagatgctgttaactatgtgttttgacccagtttaggttcaaagatacagataggttgaaaat

SEQ ID NO: 46914 - DNA, 741 bp, Homo sapiens
actgggtaatatataaagaaaagacattgatttcttaatagctgtgaagtctgggaagtccaaggttgaggagccatatctgatgagggcctttttgcctctaatgatggagggcacctcatgggagagagcaagagtgccagctcaggtctgtcttccccttcttaaaagcccctattcccatcatggggaccccaccctgatgaccttacttaatcctaattactttccaaaggccctacttccaaataccataaacatatgaatttggggattaatttctcaacacatgaaatttggggatacattcaaactatagcacatattgaaatggggaaaggcctttaaattataaaggaaatgggtttatataaaaattaaatactttatatggacaaaagccatataattaaaaagcaaatagagaaaaaagatggcagcttttattaatacataactttctgccatatattagaatgaactcttaatattcagaaagtagaaaagattaatgactcattagaaaatacggacaaggcaatgaataggcagttcacaaagaattaaaaagctcataggctttttttttccttttgagacggagtttcgctcttgttgcccaggctagagtgcagtggtgcgatctcagttcactgcaatctccgcctcccgggttcagtgattctcctgcctcaggcctcccgagtagctgggattgcttacaggtgcctgtcaccacac

SEQ ID NO: 46915 - DNA, 422 bp, Homo sapiens
attcatgataatgttaattataaagcaaaatagcagcgactgagatatttagttcaaatataagcacaatatgaacactggcagtgttaataactggtaagatttcaaaatccctcctagttgtgcttcattactccaggtataaatatttactcaacttgagataaaatttttctcacaaatgattaataatatacatagggtttttttttttgtctgaatgcagagctgaatatcggttttacttcatttcatgttttatatcagcacagccaaactttttctcaacaaaaaagcagcctgatttaagccacggttgcagatctttgccagactgccacaacttttattagagatgagtattttacatgcttaccatgatgcactcagttgggggctctttattgttatcatttcaattc

SEQ ID NO: 46916 - DNA, 439 bp, Homo sapiens
tcacagttaataagtgcagaccgtttctggtgaactgggaactagtaataggaaagtgcttgcagatccacagatgggagaagattggtagaggggaatttttaagtggtcataatgtacttgtggcttggaggcattagaaagtattaactgccatttaaattgaatatatagtatgtcctgtctcctttataaggccacagattttatctgtaaaacaaagcactactttccttgaagtaatacgtgtagtgagcagtactgtttcctgccaggggctgcagttggttatatttgaggctgacttgcttctttcttgtcttagcctctcttaccagtttctttgcattttaaatattcaaatgaatcagcccagagtcttattttgggtgattgctgtatacttttttctgagcagtgtaacacataggaggaagtt

SEQ ID NO: 46917 - DNA, 887 bp, Homo sapiens
  misc_feature (214)..(214): n is a, c, g, or t
catagggctcggcgtggcccggcttttgaggatttcctcggtccccgggcggaaatagctggaatggaggggcctctcgattggagacttactggtcaaatatttacttttgttgatcactggaaacgctacctaccacgcattgactaggaccacagtgaggagggaacgctttagatgatagagttttgtttgggggcttttttttgttttnttttattccaggaattcaggaaattgccccagaagtccgatttctgatgtgtaaaacctttttttacagaaaaccacgacttcctggaaaagtcttcaccgtaaatattaatctctttggcatgaagaggaaaacactgcagctaatttttcatgggataacaaaaatataaactgcaatttcttttattttttccctttcgatggtctttttaaacgaggagtaaagatttcaacgccaggtccattttccaaattttgtaccagaaccttgaggatgcttgtctctcgcgcgcttctccgcagaccgaaccctctccggaactcagagctgttcacccaagtcagcggaggaggcctcctgggacttgagcctgagggtggcgaagaaccctaggcagagatcatcaacttggtaccgatgagtgacgcggagcttgaacattccagcgacttgctccagggccactcccagttaagaggctgagtgttaactgcaagaggctgagtgttaactacgccgttggctccaggaaccgaaccgggtttggatacagacccagtcacaccatccatgaaaagctgtttctataatatgaaaaattgttaaatgacgctttagtaaaagccatttaaagatcttttctaataaatttttcatctttccaaacaat

SEQ ID NO: 46918 - DNA, 791 bp, Homo sapiens
cttcccggggcgcctaggccagggcgggcccccagcgtcgtcctctcccacccccccactcccctgcccacacattctggatcaaagcagacatgcggccggcgctctgcgatccaaggcacactggggtctttcatccggtgtttttaaaaaggaggaaacaaaaggctcagaggcagggccccagaaaaccacgacttcctggaaaagtcttcaccgtaaatattaatctctttggcatgaagaggaaaacactgcagctaatttttcatgggataacaaaaatataaactgcaatttcttttattttttccctttcgatggtctttttaaacgaggagtaaagatttcaacgccaggtccattttccaaattttgtaccagaaccttgaggatgcttgtctctcgcgcgcttctccgcagaccgaaccctctccggaactcagagctgttcacccaagtcagcggaggaggcctcctgggacttgagcctgagggtggcgaagaaccctaggcagagatcatcaacttggtaccgatgagtgacgcggagcttgaacattccagcgacttgctccagggccactcccagttaagaggctgagtgttaactgcaagaggctgagtgttaactacgccgttggctccaggaaccgaaccgggtttggatacagacccagtcacaccatccatgaaaagctgtttctataatatgaaaaattgttaaatgacgctttagtaaaagccatttaaagatcttttctaataaatttttcatctttccaaacaat

SEQ ID NO: 46919 - DNA, 804 bp, Homo sapiens
cagcgcgcgcacacacacacacacacacacacacacacacacacacacacacggttttttgttgttgcagagttttaagtcctaaatcttatctaagtgatttaaagtgatttttcatgattgattttatttcttgagaagagaaaaatctttccaacaaaacataatggaatttcatgactttgttttgctttctctctctctctctcttttttttttttgagacagggtcttgctctgttgcccaggctggagtgcatggtgtcatcatagttcattgcaacctccacctcctgggctcaggcagtcctcccacctcagcctccccagtagctgggaaacaggtgcacaccaccacacccagctagaattttgtgacaaatgttttaacatttgttcctgttctagcctagaaagctatacaagattggattaataatgattcacatcaaagcctcaccagcatttttttttaattgtggcaggcaacatgctaggtattaggaatacagaaattaatgaagaaaattattcctcccaagaagtatacattagaatgtaagagagcaccgtgtcaataactatatttgttcagaaatatctcattagtagagttagattataaagtgtattaaggacataatagagtgagtggctggctctacctgggggaggaggttgtcagaatagcttcctagaagtgatacttgaacaagactttaaggatgaagaggagtgtgctaagtggataaggcaggataggctaagtatatagaaagtttaaaatttaaatggctaacttta

SEQ ID NO: 46920 - DNA, 421 bp, Homo sapiens
atttgtttattagccaggcatggtggtgcatgcctgtaattccacctactcaggaggctgaggctggagaattgtttgagcctgggaattcgaggctgctgtgattacaccactgtactccaacctggatgacagagggagcaagaccctgtctcaaacaaacaaacaaatacctccagatacagtgagaatggcaaggaattccactaacacaggaccatcctcattctcaatcttaccagcaccatcataatttttgacatatccacaaactccctacagtatatattcctaatacagtattcttcaaattgactcacatttttacttaaattacttttaaatggaaattttagctgtctactatacctggggaaaaccagtagtagcacttgctaaaaatagaaggaaatgaaattca

SEQ ID NO: 46921 - DNA, 754 bp, Homo sapiens
  misc_feature (750)..(750): n is a, c, g, or t
  misc_feature (752)..(752): n is a, c, g, or t
gggagaatcagaagggcagagggcatcagttgggaagagtctgtggttggagactgcaaacatgtggaagggagtttggagggacactggccaggtgcctgaacacgtggcattctctggaaggaactaaccagcgtgaggacatgctgattgcatactcagccaccacccatgaaggctctaaacctgagtacctgtaattccggcttcaccctcagcttgcagagtgagctcagggagaccatttggatgtggctaaataccccaggctgcttgctgcagcacggtcgttgtcaaggatacttggttgatgaataaaacatcccagaaacgagaggtgcatctccgagaaagtcctgcaattgacaagaggagccccagtaccatctgggctgtgagtgacagaggagtccctttgcaggccataggctggcagggatggagggctggacaggtgcttgcccaccgccggccacgggaaagttctctccctgtcactgcaacgtgcgacagggccgctaaaaaggtgacccctgtacgaaggaatgaatgagataaaacagagcaagcgctgggaaaaagggaatgaaagctgacgttcactgctttttgttctcccttgggtctctgtggtccaggaaaatgcaacatgaacctcgattgttctgtggaccattcctccctctatgaaaatttacataattcttgatgtcaaatttcaaataacacagaagtttatagagtaaaaananaa

SEQ ID NO: 46922 - DNA, 1803 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccggagaagaagacacatgaattagagacagcacgggggagcaggctgtggagctgggagtgacggggtgagtccaggaaggctgcctggaggagatgcccaggagagaagtttgctgggaggcagctcatttccggcaggaggagcagagcctgccaaggcctcgagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtgg

SEQ ID NO: 46923 - DNA, 2230 bp, Homo sapiens
  misc_feature (3)..(3): n is a, c, g, or t
  misc_feature (5)..(5): n is a, c, g, or t
ggnangagcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaag

SEQ ID NO: 46924 - DNA, 593 bp, Homo sapiens
agaagtccattttccagagagaaatctcaggggctgtgccatcttaacagaacactgacctgctccagaaggcaggctcccccggtcagtatgtaaatgctttgctcctgtcagtgtttggccgtgacacattcctggcgggaaggtgagaagcttaaccagaatcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtgg

SEQ ID NO: 46925 - DNA, 437 bp, Homo sapiens
caagggagttggagggtggagagtggagggacctggtgaatcatccaagattaaatacgggcaggcactgccaggcttgtgtggagatgaggctgggacactgttcgcaggaagagtccggtgttctggccccctgatgtcaccttcacgggcctgactcacagtcctaaatatctgacagcgagatcgcttgtaggtaggcttcttgtcacttgtcatttaagtcccctgcctgccttttttccctgctcatttccatttcgatcacggcttctactacatgtgcttgaaatgaatgttgtgtgtgaggacctgtgtggtttgggccatgttgtgcccccctgccagtgtccttcggtgttgaaaggaaaaggtatttctctcccttccatgtatgttctgcaaattgacgaacatttgcaaattgctttgagatg

SEQ ID NO: 46926 - DNA, 3629 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46927 - DNA, 2594 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactggga

SEQ ID NO: 46928 - DNA, 3582 bp, Homo sapiens
ccagcccagagaggcgacccagctccctggaggcccaggcacctcatgtctgccctcaacccagagtggagcagaccttccctggagcttctcaggagccacttcaaaagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46929 - DNA, 3668 bp, Homo sapiens
caagggagttggagggtggagagtggagggacctggtgaatcatccaagattaaatacgggcaggcactgccaggcttgtgtggagatgaggctgggacactgttcgcaggaagagtccggtgttctggccccctgatgtcaccttcacgggcctgactcacagtcctaaatatctgacagcgagatcgcttgtagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46930 - DNA, 3517 bp, Homo sapiens
gcgggtgtgcgtgtgcaccccggagcgtctggtggcgttgttgggttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46931 - DNA, 3649 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccggccgctgttttctgttgcagttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46932 - DNA, 1638 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtgg

SEQ ID NO: 46933 - DNA, 220 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccggtgagtcgcctggggctggggccgggccggtggggccccgcggcccggagaagggcgggggcc

SEQ ID NO: 46934 - DNA, 2961 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcacccaggcgcacttcttaccacaaggcacacctacaccccttatccccatactagttattatcgaaaccatcagccgactgtcatctcag

SEQ ID NO: 46935 - DNA, 2264 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaag

SEQ ID NO: 46936 - DNA, 2962 bp, Homo sapiens
gggcgcgcgggcccgcgcaggcggtggcggcggcggcggaaccgagctgacgggcgtgcggccgctgcgccgcaaactcgtgtgggacgcaccgctccagccgcccgcgggccagcgcaccggtcccccagcggcagccgagcccgcccgcgcgccgttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46937 - DNA, 3595 bp, Homo sapiens
  misc_feature (3)..(3): n is a, c, g, or t
  misc_feature (5)..(5): n is a, c, g, or t
ggnangagcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccatggagggagttccaacaacctctgccacaccctggggcctgtgcatcctcctgacccacagaggcatcccaacacgctgtcttttcgctgctcgctggcggacttccagatcgaaaagaagataggccgaggacagttcagcgaggtgtacaaggccacctgcctgctggacaggaagacagtggctctgaagaaggtgcagatctttgagatgatggacgccaaggcgaggcaggactgtgtcaaggagatcggcctcttgaagcaactgaaccacccaaatatcatcaagtatttggactcgtttatcgaagacaacgagctgaacattgtgctggagttggctgacgcaggggacctctcgcagatgatcaagtactttaagaagcagaagcggctcatcccggagaggacagtatggaagtactttgtgcagctgtgcagcgccgtggagcacatgcattcacgccgggtgatgcaccgagacatcaagcctgccaacgtgttcatcacagccacgggcgtcgtgaagctcggtgaccttggtctgggccgcttcttcagctctgagaccaccgcagcccactccctagtggggacgccctactacatgtcaccggagaggatccatgagaacggctacaacttcaagtccgacatctggtccttgggctgtctgctgtacgagatggcagccctccagagccccttctatggagataagatgaatctcttctccctgtgccagaagatcgagcagtgtgactaccccccactccccggggagcactactccgagaagttacgagaactggtcagcatgtgcatctgccctgacccccaccagagacctgacatcggatacgtgcaccaggtggccaagcagatgcacatctggatgtccagcacctgagcgtggatgcaccgtgccttatcaaagccagcaccactttgccttacttgagtcgtcttctcttcgagtggccacctggtagcctagaacagctaagaccacagggttcagcaggttccccaaaaggctgcccagccttacagcagatgctgaaggcagagcagctgagggaggggcgctggccacatgtcactgatggtcagattccaaagtcctttctttatactgttgtggacaatctcagctgggtcaataagggcaggtggttcagcgagccacggcagccccctgtatctggattgtaatgtgaatctttagggtaattcctccagtgacctgtcaaggcttatgctaacaggagacttgcaggagaccgtgtgatttgtgtagtgagcctttgaaaatggttagtaccgggttcagtttagttcttagtatcttttcaatcaagctgtgtgcttaatttactctgttgtaaagggataaagtggaaatcatttttttccgtggagtggtgattctgctaacatttttatctacgttttataacttggtgagtgacgatgagagccctgcacctggccagagtgtcacaggcaaaaggcatcgggaagcaggagcatcttcttggcagccaggctgggccatcttctcctggacacctgctgtgtaccaggaacttcgtcacctccttgaatgctggcggttcatttcatgatcagtgttaagcattttcctccatgggaaggaagcatgggatatagaaaagcgaagggctgtcctttacaaattctggttctgcaacttcctagcgtgactttgggcttgggcaagtttcttagccgttctgagccttcatttcctcatctgtacaatgagattaatagtacctatcatctaccttcaggattgctgacagacagaatttgaaataaaatatgcaagttagctaatacaaaaagtagatgatccaaaaatggtagccactcacccttcacaaactgaagtccatggaccacggaagtcgagaattaatgtacacctgtatcatgtgtaggaaaccagaaatgtgttccttatttcttgttcccaaacaggattaactgtgaagactaatttataaatgtgaacctaagaaaactccacctctgaaggaaatcatttgaattttgtttttgtacgtaaagttaaccttccaattgtctgagctgtcgtcactgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46938 - DNA, 1696 bp, Homo sapiens
  misc_feature (3)..(3): n is a, c, g, or t
  misc_feature (64)..(64): n is a, c, g, or t
  misc_feature (113)..(113): n is a, c, g, or t
  misc_feature (125)..(127): n is a, c, g, or t
  misc_feature (147)..(147): n is a, c, g, or t
  misc_feature (172)..(172): n is a, c, g, or t
  misc_feature (203)..(203): n is a, c, g, or t
  misc_feature (205)..(205): n is a, c, g, or t
  misc_feature (216)..(216): n is a, c, g, or t
  misc_feature (229)..(229): n is a, c, g, or t
  misc_feature (248)..(248): n is a, c, g, or t
  misc_feature (263)..(264): n is a, c, g, or t
  misc_feature (294)..(294): n is a, c, g, or t
  misc_feature (308)..(308): n is a, c, g, or t
  misc_feature (313)..(313): n is a, c, g, or t
  misc_feature (318)..(318): n is a, c, g, or t
  misc_feature (320)..(320): n is a, c, g, or t
  misc_feature (348)..(348): n is a, c, g, or t
ganggggggtgggggcaagtgttttagccgtttggagcctttatttcctcttttggacatgganttttattgaggacctgagttttttaccttcttgttggcggtacatacanattgggaaagannngtggcaagggagcgaagatnatataaggttgagtagccaaaatgnggatgctattgcaccttgcattatacggaangncagggacctcngaaggcgagaatnaagtttttttttttttttntggaggatttttganntgtgggccttatgtttttttcccattctgnaggttcggggaagncgatntgttnanggggtactgtagaatattctaccttggnagtttatttttggattttgtgggggggattttaagggatccgtttaaggggctgagcgggctgtatgacttcatgacagtctggccctccagacaagagcagcgctggcatcgggcaggtgattcctgacacctgctgcctgcaggcattcactgaccaggcctttcctggaggaaacacccagggccgggcggctgctgtttccacacgtggactcggatctgctgtgacaccgtcagcccgacagtctctccatatgcagcctttcctctgtacttttctccatggttgaaataaaacagggtgactgggagttacttagaattcatgaagattttaaaatggctttggagattttgcttttaaaccagtagattcaaaacttaaacagcgtctgcagcacaatttcttgaggaaccttgaaaaacacaacttcccaggccccattcagtaatcccaggatttctttaagctccccaaataattttgaaactcatcagccgagtttctgccctcatgaggtaattccatcgttctccccagcctgcccctggcagctgtaacacaggagctggcctgagagcagattcaccctggaatgttctctccacagaacaatcaagtccctgtcgcctgcctagtgcttaccactgaagatttttctgattccagaccaactttttgccaacattctgcttccagctctctgagcccctgccgtgtctccccaacactgccagccccagcacgcaatcaacctactttgtgcatgccacccgctttccacactgtgagaacaatctgcccaactggaccctctggaggcgcacgatctcagccactcaccaggcctgagtgtttgtgaaatgatcatgtcctacttattacaaaaccgtaaccccaaaacattccttttatttctgtgaaaccggccaaagtgaggtccacccaccttcacacagctctggcggtgcacctgctcaccttctcttggttctcagaactgagctgggcttgagaacacagctttggctttgccatttttttcctacttggctgctgaggtggagggtgtgctgcacttatcaccccatttcaaaaccaaaccaaacctgaggccaccccaaacaaattcagccagcaaaaagggtaggtatcgatggtcacctgaagcctcaagggagtccactctgacttctgacagcagacagaacctatctgtcctcaggaggggcgcatggctaacctacgctctcctctgagcctaggccagtgctcaaggaggatcagcaccctgaagggccaggccaatggccttagcagccccctactgcccccaaaaacacca

SEQ ID NO: 46939 - DNA, 380 bp, Homo sapiens
ttttaaatgctgatcacaacacactaaattgatttcacaacctattaatttaggctcatgacccatagtttgaaaaacactatcttacaacttttgtgatagtcaaacaggtcagggtcactggtctcattatctaaggtgttatcctagttcattgcctcatgactgagaaagttaaggaatgtggatgcaaagggtgaggttgcagtgaaagtttaatgagtgaaaaaagaaagctctctgcagtggaaagggaaccccaagtgagttgctgtttttacagctgaattcaaaaacttttataagaaactcctctcacctctgtagctgtttgagtaacttctcttatttgaaaagctgtctgcacaactcccccttat

SEQ ID NO: 46940 - DNA, 442 bp, Homo sapiens
tgcatagcccagaatgatgcatgagaagacagagaataaggtgtcaggtcctaggcattctaactgcttccaatcttgggaaaataaagaagacacaaggacattgttcaaatccaccccagttcccatagccttttctcctagctcatttccaactctctcacatttgtagacatcttctgaactcaatgtgctttaaagacaggctggactcaaatcatcctcaatccctctgtcagcaagggacagcaggcattgtggcacccagaatgagtaacacggctgtgctctcttagaaagttgacattgagtgtgaatggaggactctggccctctggactatatgttttcttcaactgccaggcagagagagcaagacaacttgtgaataatcattcgctcacataaatgcaataaacgttaataatgatcacattatcta

SEQ ID NO: 46941 - DNA, 402 bp, Homo sapiens
ttgagtggaaataggattttgtcatgttggccaggctagtgttgaactcctgacctcaaatgatccacccaccttggcctcccaaagtgctgggattatgggcctgaaccaccacgcccggctgcctcctgcttatttaatagtagttatccttaatattgggtaaagtgattcttcttttgttctttgtcaaaattgttttagatattttaaggttggtgtctttccatatacattttagaataaacttgtctgtgtttataaaaagtcttgagatatttggttaggagtcgtaataaacttacagattaatttggggagaattgacacctttattatgttgagtccagtgcatgaacatagtagggatgtctccatttgttgaggtctccttcagtattt

SEQ ID NO: 46942 - DNA, 337 bp, Homo sapiens
gagtcatagggaagccatcccagaagccaggtctactcatcaataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgggggaaaatacctagggctcaacagtcttgagaagtgtggaaacattttctttgtgagtgagaacagatcacctagagaaaggagaccagattcccatcactgcttctgggtatcagatgctagc

SEQ ID NO: 46943 - DNA, 548 bp, Homo sapiens
accggttgatgggacttatggataggttccagtttggggctgctagaaataaagcttctaggtacattcatttcaagtctttgtgtgaacaggtactttaacttctctcgggtaaagagaaccgttctaatctctgagaacttagggctcagcagagagtccagtgctccctgagtggatgaacttgtgcagaactaaagcagaaagaaggcaggaggcagaaaaaggcttaggtttgaaaatctgtgagctgccaggccctggacaccctccgacccatttcagccttctcctttcccccagccccttcctagaagccatacctgcctgctgtcctgagatcagttccctggggagcaccaggggacggtgtcctgtatgttcctatccttggcccacagttcatggttccagctgccaatccccaccctggcaggacctggaccatgtcctaagagctgccctctgtcagtccttagcctccctgagaacttgggttcacagtaggttttcagaagcgtgacctgcagatgtgtgtgtatgtgaac

SEQ ID NO: 46944 - DNA, 339 bp, Homo sapiens
atgtaatcattaaaatcatatatcaaaaatatctaatggtgtaaaaagatgtctcaaaacagaatgacaagtgaaattctttttggggataaatgcttagaaaaaatatttatttaaagattagaaaaatgtaatgaaacagaaaaaggtattgctggatagtagaattactagtaacattcacttttttccttttggttatccacattttctaaatttcacatttcttttgtaataagaaaaattaaagctattttaaatatacctatatttgttcacagaaagagaactggaataaacaaatgggaagacatgtagagtaaaagttgttttatttct

SEQ ID NO: 46945 - DNA, 656 bp, Homo sapiens
gcttggagcccaggcagagatgagagacaaagtcacagcttcctctagatcctaaagacccaggaacagaacttcccagaagaagtaatcttgacttcctgttccactccagcccatcagcaaagcttgtccgttctatctccaaaacaggtcttaaagctgccgcctttccctggctttcttactgcccccagtggaagctcccttcatctcccccagggctaccccagtagcttcctttctttgccctgaaaggctttctatatacagcatataaaagaatctccttcaatcataaatatggtcacagcgcttcctcgcctaagaaactcatggccaactcctgtgtttcagataaatgctaaactttgatttgtgctctaacccactagggctgctgtgacctggctgcacctggcctggacctgctctgccctggatcacgtgatacccccaggctcactcttcttttcccagtttctcaaacacagcaagttctgtcctaactctgggcctttgcataccttccctctctactggaaccctcccccaacctttctcactgaggccaacttctgcataggctgcaggcttttgcttaaatgtcacttctttgcaataccttatcacactggaccttttccccttccatggct

SEQ ID NO: 46946 - DNA, 482 bp, Homo sapiens
gaagggcatttgttttgttgggatagctacataacagtctgatactgagtcttatggtttatgctaagtggttcttcacaagtttccttggttttcctggctgataatgtttgcatagaggacagacaaaagggggctggaactgacttgttaaaaatagacgtaaaatgaattctgttttcagctgtcactgatgctcgcaactgcatgtgatgtcctgggccatgggtgaatcctttgaacttaatgcagagaatgtcttgtgagtagatatgtggagatgtgcgtatggagtctttcagcctttctgttaagtggcaccttacctccatcattcattgtatgcggtgtcatagttctgagtccttcctaggttccctggggcagactggttagctgcctttgccctctgaaataaattactacttctccacctacttttgtcttccaaagctttctcagatgtctagtggatataatac

SEQ ID NO: 46947 - DNA, 639 bp, Homo sapiens
  misc_feature (634)..(639): n is a, c, g, or t
caacaccacaactggtccattttccttctgcttgaaatggataattctcggtaccagcccttcgcccttcagcatgcactgatggggccacgctcctgtctgggttctgaggattgccagggaaacaggaggtgctataagagatgacaacacaaaccccagaattgttaatgttttcactgtccatgatgtatttctatttatcagagtcctggggtcgctttgcttgttgttagataaaagcagtatagtgttatcagtcataattaattatattttcaaactttaacttggttgcaactttacttcttttatctggaaccagtatatgctaggctggtagttttatgttgaggattcacttcacttatctatgcatttttattaatactctaatgtttagaatctacttcagatgtactgactctatttacttgataactttgatatatttttagtaaattctaatgaagtgctaggtatttgtggcatctaatgtctcaggatttttatgttatatatgaaaatgttttctttgtaaggttatatataagcatttttataaattggatgtaatatagcctctttgaaaatattgctaatacattgtgttgatagatattttctctaaaannnnnn

SEQ ID NO: 46948 - DNA, 213 bp, Homo sapiens
ctgtctgttctccaggacctgtctgaccacccatctccctcctgcagtctgactgtgtgtatcctatagtagagatgccagggccctcctcacccatccaggggtggacccttggtggagacgccacgtgggacagagggagagggcgggatgcctggagtttctcttctaccagccttccaggcgcccgctagtgcccactgctggccaaac

SEQ ID NO: 46949 - DNA, 1755 bp, Homo sapiens
gcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46950 - DNA, 1538 bp, Homo sapiens
gcgggggctgcgggagacgcagcagtttgcgatctgcccacgcgttcgggcactagggccaccgctcttgtgggcagaaggccgcgtccattccaggaagaggatcttctccggaaatagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46951 - DNA, 1242 bp, Homo sapiens
gcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcttttaaaaacacgggaaaaagtaggacaatcggagagtaccgcgagctcgatattccggctgacggagagtggtaatcctttatagtccggtaaca

SEQ ID NO: 46952 - DNA, 1421 bp, Homo sapiens
gcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46953 - DNA, 884 bp, Homo sapiens
ataggaagtagtaaattaggaaaaataaagataatggtatgttggtcgtgatatcgcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46954 - DNA, 1164 bp, Homo sapiens
gcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46955 - DNA, 1868 bp, Homo sapiens
gcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgcccgtgataggagctttgtgggagtgggatttgtcaatttcctataagaatattattctgaagacctggaggaggaggtagcagcagcggtgaaaaatgggaatgacttctaatagtttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46956 - DNA, 1705 bp, Homo sapiens
gcgggggctgcgggagacgcagcagtttgcgatctgcccacgcgttcgggcactagggccaccgctcttgtgggcagaaggccgcgtccattccaggaagaggatcttctccggaaattaacagatctgattctgcagctgatcaaggatgacactggtgagaaccctatgagggagtgaagcagcctggactcttaccacaagagggaggtgttataagagcaatgcagaggttggagtgggcagcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtggacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46957 - DNA, 863 bp, Homo sapiens
ctcgtgccgaattcggcacgagagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttgtcga

SEQ ID NO: 46958 - DNA, 296 bp, Homo sapiens
gggagcttctgcagaactcaaaaacttgctccctccccaacctactaaatcagaatctccatgtgtgaggtgaattcttctataacttggtgtaaagctcacttaatgcctctgacatgtatgcttggttagtgtggttagtagaaacggaaaaataaatgtgtattttgatgtcatttgatcttatttcatttttcaagcagtgaggcaacgtaggatattaaacaattattttatcagacagtaatttgccacaaaaatgtctagttgaacctacgcatgcctatgtatatatt

SEQ ID NO: 46959 - DNA, 562 bp, Homo sapiens
  misc_feature (243)..(243): n is a, c, g, or t
aacacagtgctgtctggcgtcaccaccatgtaccctggcatccccaacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctanacggactcaggtggtgtgcacaccactgagtcctatgactattcttatggaaacactttgacctgtggatctccggagggtgttgggggacccccagagaggcctgggcccagcttggagaactgcttttctcggccagtgccacccatttctatgatgacagcagaggtaacatgcagaccgcctccgcctgaccacacagggtccaggccacaaccttaaccacactggtcgctctaccccatgcacatgtccaggcacctgctcttccagaccagacctgaccctccccagtgagctgcctcagcaaagagacctg

SEQ ID NO: 46960 - DNA, 308 bp, Homo sapiens
aacacagtgctgtctggcgtcaccaccatgtaccctggcatccccaacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagattttgctgcatgggttaattcagaagtataaatttgcccctgg

SEQ ID NO: 46961 - DNA, 692 bp, Homo sapiens
  misc_feature (14)..(14): n is a, c, g, or t
ggagcccttggacntgaggctgtcgcatgatatgccaagggtcttgttagggtgaggatggtagactgggagaaaggcagagggagtcaggtgtgacttagcaccccctctaggcagagattgagaggaccaggcaggatgatggcactcagccccttctcagagggtgtgtggtcagaagtgctttcatctggcaggctggagatccaagcccaacttggccactcaccagatggtttgtaacttgggcagattatcgagcagggtttaattctcctcgtttgtggaactggcccagtcactgtgggactgcgacaagtaacaggtatggaagcatttgacgtggtgaatgaaggcattgccagtgagtctctattttggccaccattgccaacagtgaatgtggttccttggtgccttccctaagtaagactgacatgatgaaggtgaggtcactgacccctgtggccactgcaggcacccagcaacctgaatgtgtattccatctgatggcataggcccagaaagaactgttctagcacagttcttactcccacaagctcctccgttttgcccctttcttcccctcctctgcctccaccccttctctgtccttgcagagctgcacacgctgtcatcaaactcctaccccttgattctcaaaacgagggatttggaagaacaagaaaaaa

SEQ ID NO: 46962 - DNA, 296 bp, Homo sapiens
aggttaccaggagaccctctggattgatggaagtgtcctctagattgtttgggtagtggtcccgtgagtgtgtacagttgttaagtcatggaattgagcacataagacctgtggattttattatatgcaaattataccttaatttttttaaattgcaaaaggctaatattagttttacaaaagtgtatttagccaataaaaagatattaaaatagagacaacaaaggaaaaagttaaatgctgcgtataagcactttttggccagttttagtgtaagggcactaagaagtctgatt

SEQ ID NO: 46963 - DNA, 393 bp, Homo sapiens
catgaatttataatagagaaagcagcttccctacctggctactggataatatgttatattaaatttgtcactgctctttcactgtttaaagtgaaatgaagaattcgttagcaaaagaaatactttaaggtctaaataatatatcaaatatatatgtaatacaacatgaaatttcctttatgtcataagaaatactttcttattattttagataaattacatgaaccagatgtgacactctggattatcatcttatctgccatttaattttaattttgaattctttccttttaagatcacaaagaacaccaatcacaatgccttgtacatgccaaatgaccaaagaagatttgatgatattttaaaattctcacacgacttttatttttcagc

SEQ ID NO: 46964 - DNA, 305 bp, Homo sapiens
  misc_feature (11)..(11): n is a, c, g, or t
  misc_feature (13)..(13): n is a, c, g, or t
atctagaggancnttttgcgggtccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctctgggacagaacgagactttgtctc

SEQ ID NO: 46965 - DNA, 290 bp, Homo sapiens
ccccccagccacgggtcgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccgggggtgcgtgccctgggggggggatcctcaa

SEQ ID NO: 46966 - DNA, 2120 bp, Homo sapiens
  misc_feature (2062)..(2062): n is a, c, g, or t
  misc_feature (2069)..(2069): n is a, c, g, or t
  misc_feature (2074)..(2074): n is a, c, g, or t
  misc_feature (2078)..(2079): n is a, c, g, or t
  misc_feature (2105)..(2105): n is a, c, g, or t
  misc_feature (2110)..(2110): n is a, c, g, or t
  misc_feature (2112)..(2112): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46967 - DNA, 2063 bp, Homo sapiens
  misc_feature (2005)..(2005): n is a, c, g, or t
  misc_feature (2012)..(2012): n is a, c, g, or t
  misc_feature (2017)..(2017): n is a, c, g, or t
  misc_feature (2021)..(2022): n is a, c, g, or t
  misc_feature (2048)..(2048): n is a, c, g, or t
  misc_feature (2053)..(2053): n is a, c, g, or t
  misc_feature (2055)..(2055): n is a, c, g, or t
taaaaattaggctaagtacgaggctcggtgttaatcaggccgaggggagcccagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46968 - DNA, 2066 bp, Homo sapiens
  misc_feature (92)..(92): n is a, c, g, or t
  misc_feature (2008)..(2008): n is a, c, g, or t
  misc_feature (2015)..(2015): n is a, c, g, or t
  misc_feature (2020)..(2020): n is a, c, g, or t
  misc_feature (2024)..(2025): n is a, c, g, or t
  misc_feature (2051)..(2051): n is a, c, g, or t
  misc_feature (2056)..(2056): n is a, c, g, or t
  misc_feature (2058)..(2058): n is a, c, g, or t
ccagcaaaagaccaaacacaagcaacaagagaagaaaaaaaaatgcaatgatagccggggtgttatgggacgacgagcgggccgcgccgtcngcatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46969 - DNA, 2046 bp, Homo sapiens
  misc_feature (72)..(72): n is a, c, g, or t
  misc_feature (1988)..(1988): n is a, c, g, or t
  misc_feature (1995)..(1995): n is a, c, g, or t
  misc_feature (2000)..(2000): n is a, c, g, or t
  misc_feature (2004)..(2005): n is a, c, g, or t
  misc_feature (2031)..(2031): n is a, c, g, or t
  misc_feature (2036)..(2036): n is a, c, g, or t
  misc_feature (2038)..(2038): n is a, c, g, or t
ctagctagtacgaggctggtgtgtaatcggccgagggtcgactgggaagcgtacgagcgggccgcgccgtcngcatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46970 - DNA, 1863 bp, Homo sapiens
  misc_feature (1805)..(1805): n is a, c, g, or t
  misc_feature (1812)..(1812): n is a, c, g, or t
  misc_feature (1817)..(1817): n is a, c, g, or t
  misc_feature (1821)..(1822): n is a, c, g, or t
  misc_feature (1848)..(1848): n is a, c, g, or t
  misc_feature (1853)..(1853): n is a, c, g, or t
  misc_feature (1855)..(1855): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46971 - DNA, 1481 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtgcagtgcgggggactgggaaactagggggggcggaacacgcgggcgtgttggagccgggggttggccgccgcctgcgcaaaaaactggcggggcacgggccttgcccgaggggggaggccgcaaggggacacctggaagcccccaggaagg

SEQ ID NO: 46972 - DNA, 1770 bp, Homo sapiens
  misc_feature (55)..(55): n is a, c, g, or t
  misc_feature (75)..(75): n is a, c, g, or t
  misc_feature (1712)..(1712): n is a, c, g, or t
  misc_feature (1719)..(1719): n is a, c, g, or t
  misc_feature (1724)..(1724): n is a, c, g, or t
  misc_feature (1728)..(1729): n is a, c, g, or t
  misc_feature (1755)..(1755): n is a, c, g, or t
  misc_feature (1760)..(1760): n is a, c, g, or t
  misc_feature (1762)..(1762): n is a, c, g, or t
atctgaggtgatctagaggatcccgagctctctctgttggggctcatgctcatcntgggtatgacgtcactgacnaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46973 - DNA, 1967 bp, Homo sapiens
  misc_feature (1909)..(1909): n is a, c, g, or t
  misc_feature (1916)..(1916): n is a, c, g, or t
  misc_feature (1921)..(1921): n is a, c, g, or t
  misc_feature (1925)..(1926): n is a, c, g, or t
  misc_feature (1952)..(1952): n is a, c, g, or t
  misc_feature (1957)..(1957): n is a, c, g, or t
  misc_feature (1959)..(1959): n is a, c, g, or t
taaaaattaggctaagtacgaggctcggtgttaatcaggccgaggggagcccagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatcgaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46974 - DNA, 2228 bp, Homo sapiens
  misc_feature (2170)..(2170): n is a, c, g, or t
  misc_feature (2177)..(2177): n is a, c, g, or t
  misc_feature (2182)..(2182): n is a, c, g, or t
  misc_feature (2186)..(2187): n is a, c, g, or t
  misc_feature (2213)..(2213): n is a, c, g, or t
  misc_feature (2218)..(2218): n is a, c, g, or t
  misc_feature (2220)..(2220): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggtagcagacgggccggtctgcccggggtcggggcgctggggcctgctgcccctcacctgctctcccctcctcttctctcccctcctcttctctcctctcccttgtcaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46975 - DNA, 1584 bp, Homo sapiens
  misc_feature (1526)..(1526): n is a, c, g, or t
  misc_feature (1533)..(1533): n is a, c, g, or t
  misc_feature (1538)..(1538): n is a, c, g, or t
  misc_feature (1542)..(1543): n is a, c, g, or t
  misc_feature (1569)..(1569): n is a, c, g, or t
  misc_feature (1574)..(1574): n is a, c, g, or t
  misc_feature (1576)..(1576): n is a, c, g, or t
gagctcggtaccgcacgagttcggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46976 - DNA, 1500 bp, Homo sapiens
  misc_feature (1442)..(1442): n is a, c, g, or t
  misc_feature (1449)..(1449): n is a, c, g, or t
  misc_feature (1454)..(1454): n is a, c, g, or t
  misc_feature (1458)..(1459): n is a, c, g, or t
  misc_feature (1485)..(1485): n is a, c, g, or t
  misc_feature (1490)..(1490): n is a, c, g, or t
  misc_feature (1492)..(1492): n is a, c, g, or t
tccaaaatctgacagaagggactggctatcagtctcacaatagttcgatgatggctaccaagaaaagacgtcagtgaacattccactgggagacagcaactctcataaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46977 - DNA, 1651 bp, Homo sapiens
  misc_feature (1593)..(1593): n is a, c, g, or t
  misc_feature (1600)..(1600): n is a, c, g, or t
  misc_feature (1605)..(1605): n is a, c, g, or t
  misc_feature (1609)..(1610): n is a, c, g, or t
  misc_feature (1636)..(1636): n is a, c, g, or t
  misc_feature (1641)..(1641): n is a, c, g, or t
  misc_feature (1643)..(1643): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46978 - DNA, 1178 bp, Homo sapiens
  misc_feature (1120)..(1120): n is a, c, g, or t
  misc_feature (1127)..(1127): n is a, c, g, or t
  misc_feature (1132)..(1132): n is a, c, g, or t
  misc_feature (1136)..(1137): n is a, c, g, or t
  misc_feature (1163)..(1163): n is a, c, g, or t
  misc_feature (1168)..(1168): n is a, c, g, or t
  misc_feature (1170)..(1170): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccgggggccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46979 - DNA, 1188 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcggtgaaaaaataaattaatatataaataaaagtc

SEQ ID NO: 46980 - DNA, 642 bp, Homo sapiens
  misc_feature (584)..(584): n is a, c, g, or t
  misc_feature (591)..(591): n is a, c, g, or t
  misc_feature (596)..(596): n is a, c, g, or t
  misc_feature (600)..(601): n is a, c, g, or t
  misc_feature (627)..(627): n is a, c, g, or t
  misc_feature (632)..(632): n is a, c, g, or t
  misc_feature (634)..(634): n is a, c, g, or t
cggaggcgctgatggcccggaggcgttgaatggcccggaggcgttgaatggcccggaggcgttgaatggcccggaggcgttgaatggctccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46981 - DNA, 1022 bp, Homo sapiens
  misc_feature (964)..(964): n is a, c, g, or t
  misc_feature (971)..(971): n is a, c, g, or t
  misc_feature (976)..(976): n is a, c, g, or t
  misc_feature (980)..(981): n is a, c, g, or t
  misc_feature (1007)..(1007): n is a, c, g, or t
  misc_feature (1012)..(1012): n is a, c, g, or t
  misc_feature (1014)..(1014): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46982 - DNA, 817 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggtactcctggactagccatcctcagcttggcctccttagccttaggtctttgactcttctttttcctccttccatcctctctttcctgatgcttcctggaaaggacactatttgtctgcttgcaggaactaactaggaaaaagaaaaaaaaataggtgactgtacttggactcatttcacaaggagggaaacagccacagaaatggatcctctgaaggccctgctgcaggttctggcaggacaaggcctcacaccttccctccccaccaagccaaacttgccaccttattgtagaccttctgggcacctttgtgttgtgggagtttagtcaggcggttggctgctatgctgggcctgtggcttcctgtgtgaagacacagtgcaggggga

SEQ ID NO: 46983 - DNA, 655 bp, Homo sapiens
  misc_feature (597)..(597): n is a, c, g, or t
  misc_feature (604)..(604): n is a, c, g, or t
  misc_feature (609)..(609): n is a, c, g, or t
  misc_feature (613)..(614): n is a, c, g, or t
  misc_feature (640)..(640): n is a, c, g, or t
  misc_feature (645)..(645): n is a, c, g, or t
  misc_feature (647)..(647): n is a, c, g, or t
cccacgcgttcgcccacgcgtcgatggcatcacttcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46984 - DNA, 721 bp, Homo sapiens
  misc_feature (55)..(55): n is a, c, g, or t
  misc_feature (75)..(75): n is a, c, g, or t
atctgaggtgatctagaggatcccgagctctctctgttggggctcatgctcatcntgggtatgacgtcactgacnaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacccgcacatccgtactgggggatccttagatcgaattaga

SEQ ID NO: 46985 - DNA, 714 bp, Homo sapiens
  misc_feature (703)..(703): n is a, c, g, or t
cactttcctgaaagtcctgtcctttgtgtgtggggtaggggcgcaagtgctgggagagtctgaagccaagtaatgaggctgttggtgccaaaagtaggatgaattttaggctgttcccaggattcctgtctccccacaggccagggccacctctgagaggaccctcgaactcctgtgctccaaggcttcaaaccttaaagggattttcaggccacggtgggaactgtggctcttgcggacccgttactctctgttcctatctcccgtccgctctctctttgcttctcacatgtggttagggcctgcaagtgtctcagggagagagacagctgcagggagcagagctggcaggcccaagttggggcagctgttgaggtgttggggcagctggcaggctgctggggctgttctgggtctcggatggaagagggcagggaggaaggttcagcctggagcagagggcttcctctgcatctctgcatcgctgagcccaggacttaaggggcccggagctgtactgttcccctcagagaaggtcttctccaggcctggggtaggggtgacagttgggagcaaaataactttggcccctggccccctttaggaatcctacgccaacgtgaagcagtggctgcaggagattgaccgctatgccagcgagaacgtcaataagctcctggtgggctcactttatggaggtttntcctctggagt

SEQ ID NO: 46986 - DNA, 2015 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcggtgaaaaaataaattaatatataaataaaagtc

SEQ ID NO: 46987 - DNA, 1789 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctcttgctgtccacctcctctgtgctgtccacctcctctgtgccctcctctgtgcgatcca

SEQ ID NO: 46988 - DNA, 2034 bp, Homo sapiens
  misc_feature (15)..(15): n is a, c, g, or t
  misc_feature (1976)..(1976): n is a, c, g, or t
  misc_feature (1983)..(1983): n is a, c, g, or t
  misc_feature (1988)..(1988): n is a, c, g, or t
  misc_feature (1992)..(1993): n is a, c, g, or t
  misc_feature (2019)..(2019): n is a, c, g, or t
  misc_feature (2024)..(2024): n is a, c, g, or t
  misc_feature (2026)..(2026): n is a, c, g, or t
tctcagtaccccggnttatgtgggaggctggggccctgggagcgacgaggggcgcgatcgcgcatgaacggggatctgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46989 - DNA, 1718 bp, Homo sapiens
  misc_feature (13)..(13): n is a, c, g, or t
  misc_feature (1660)..(1660): n is a, c, g, or t
  misc_feature (1667)..(1667): n is a, c, g, or t
  misc_feature (1672)..(1672): n is a, c, g, or t
  misc_feature (1676)..(1677): n is a, c, g, or t
  misc_feature (1703)..(1703): n is a, c, g, or t
  misc_feature (1708)..(1708): n is a, c, g, or t
  misc_feature (1710)..(1710): n is a, c, g, or t
gggatatcgtcgnccacgccgtcgggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46990 - DNA, 1754 bp, Homo sapiens
  misc_feature (14)..(14): n is a, c, g, or t
  misc_feature (1696)..(1696): n is a, c, g, or t
  misc_feature (1703)..(1703): n is a, c, g, or t
  misc_feature (1708)..(1708): n is a, c, g, or t
  misc_feature (1712)..(1713): n is a, c, g, or t
  misc_feature (1739)..(1739): n is a, c, g, or t
  misc_feature (1744)..(1744): n is a, c, g, or t
  misc_feature (1746)..(1746): n is a, c, g, or t
atttgaggatcacngagcccatgggctaagtgatcctcgtgggtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46991 - DNA, 2297 bp, Homo sapiens
  misc_feature (2239)..(2239): n is a, c, g, or t
  misc_feature (2246)..(2246): n is a, c, g, or t
  misc_feature (2251)..(2251): n is a, c, g, or t
  misc_feature (2255)..(2256): n is a, c, g, or t
  misc_feature (2282)..(2282): n is a, c, g, or t
  misc_feature (2287)..(2287): n is a, c, g, or t
  misc_feature (2289)..(2289): n is a, c, g, or t
cactttcctgaaagtcctgtcctttgtgtgtggggtaggggcgcaagtgctgggagagtctgaagccaagtaatgaggctgttggtgccaaaagtaggatgaattttaggctgttcccaggattcctgtctccccacaggccagggccacctctgagaggaccctcgaactcctgtgctccaaggcttcaaaccttaaagggattttcaggccacggtgggaactgtggctcttgcggacccgttactctctgttcctatctcccgtccgctctctctttgcttctcacatgtggttagggcctgcaagtgtctcagggagagagacagctgcagggagcagagctggcaggcccaagttggggcagctgttgaggtgttggggcagctggcaggctgctggggctgttctgggtctcggatggaagagggcagggaggaaggttcagcctggagcagagggcttcctctgcatctctgcatcgctgagcccaggacttaaggggcccggagctgtactgttcccctcagagaaggtcttctccaggcctggggtaggggtgacagttgggagcaaaataactttggcccctggccccctttaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46992 - DNA, 1358 bp, Homo sapiens
  misc_feature (1128)..(1128): n is a, c, g, or t
  misc_feature (1150)..(1150): n is a, c, g, or t
  misc_feature (1170)..(1170): n is a, c, g, or t
  misc_feature (1179)..(1179): n is a, c, g, or t
  misc_feature (1234)..(1234): n is a, c, g, or t
  misc_feature (1269)..(1269): n is a, c, g, or t
  misc_feature (1348)..(1348): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgccacnacctcttgtagagtgtggcagnctgtatctttcagtgtaacnaagttctantaaaggtcataactgctaccctgtaacttttgccttattctagaaacttctactncttgaatgacatgtgttggtacatgtttcttctcnttcagatagaatggttaattttgacttgttgcttctgcacacgtgtcctggaaataaaatttcttcccacaccgccacnacctctacag

SEQ ID NO: 46993 - DNA, 1275 bp, Homo sapiens
  misc_feature (1217)..(1217): n is a, c, g, or t
  misc_feature (1224)..(1224): n is a, c, g, or t
  misc_feature (1229)..(1229): n is a, c, g, or t
  misc_feature (1233)..(1234): n is a, c, g, or t
  misc_feature (1260)..(1260): n is a, c, g, or t
  misc_feature (1265)..(1265): n is a, c, g, or t
  misc_feature (1267)..(1267): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46994 - DNA, 1071 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacccgcacatccgtactgggggatccttagatcgaattaga

SEQ ID NO: 46995 - DNA, 776 bp, Homo sapiens
  misc_feature (718)..(718): n is a, c, g, or t
  misc_feature (725)..(725): n is a, c, g, or t
  misc_feature (730)..(730): n is a, c, g, or t
  misc_feature (734)..(735): n is a, c, g, or t
  misc_feature (761)..(761): n is a, c, g, or t
  misc_feature (766)..(766): n is a, c, g, or t
  misc_feature (768)..(768): n is a, c, g, or t
ggacgcgtgggtcgccacgcgtcgtcgacccacgcgtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaaaaaaaacaaaaaaaaaaaaaaacaaaaaaaaaaaaaaaaaaaacaaaacacaanaaaaaanaaaanaaannaaaacacaaaaaaaaaaaaacaaaanaaaananacaacaga

SEQ ID NO: 46996 - DNA, 758 bp, Homo sapiens
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgctaccccctctagagccaaaacacactacacac

SEQ ID NO: 46997 - DNA, 658 bp, Homo sapiens
  misc_feature (644)..(644): n is a, c, g, or t
tccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcggcaggagaatcgcccgagcccgagaggcagaggcgcagcgagcccagatcacgccactgcactcagcctggtctcnagggtcctctagac

SEQ ID NO: 46998 - DNA, 1076 bp, Homo sapiens
aatagcagaatatgtaaatgcttatagtttgaagactcggacacataaatgggatttgacctcattccaacaccttcgagaaccttgtggaactcttccttaaagatttgtttcatcttagagaagaatttttcctgctagtcttgatctctgacactcattgcattgtcgctttctgataatagtctagcaatgcagtatttcagtgctgttccttttagacatacgcgaagtagtcctcgatgacacatggagcgtttctatcatattctttcttaatttatccagattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacctccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaa

SEQ ID NO: 46999 - DNA, 4302 bp, Homo sapiens
tctctctgtaatgtttgatacttgagggaaaacagctgggcctgagcatgctgactccctgcaaagtgcaatgggctgctggggaatatggactgtactgtatggctgaaaggtcagctttttcccttgtctctcttggaggaatgcagggtctgtcctcacattcgccttgtgagcccttagaaggagccgggagaggcggaagggctggctgcaatgtggcagacagtcttagccaatgggatggaagaggctgtttgcatctctttccctttcctgccctgctgtttttgattttcgggggagggctggaaaaagccaacagaattttggtttggagaagtagttgatgaccacgttaaacagcaagccctgatgggccagacagatgagagcctggcccaaaccacagcagtgaaactggaattacagggccagcatcggagggagagtcctgctggagtcctcctaagagaggacaaggaagtagttgagacagatgcccccacaggccacttgcccccacttgcccttgagggcaaggatgtgtgtttccgtgcctaggacctaattctacgccgatttagatcttaagatggtatgtggcactttgtaaacctcttgggcaaatttttgttggttcccaagttcagcaacagagctgccgaggttcagactggcagcaaggccggctacatccaagccacacgggcaaagctcggagcaattacctgattaactttttcctttgtttctttgccagtcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcgagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacctccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaa

SEQ ID NO: 47000 - DNA, 1432 bp, Homo sapiens
attttgaagagaggggtcccggggagctccctccaagatctagaggctccgcggccacccctgccgggtcctgccaagacttgctagaaggaacgagtcgcgtgccttagttagttggttcccgtcacaggaagaaacgcctttgcagtgggtttaattgcttctgggccgagcgaattccccgccgtacaactcagtggtgcggactttgcctcctgctaccctgttgctgcgccgagcggggtgggaaagtttctggagttgtcagtcgcgcagcccgtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgccgcggggactgggacgcacggcccgcgcgcgggacacggccatggaggacgcgggagcagctggcccggggccggagcctgagcccgagcccgagccggagcccgagcccgcgccggagccggaaccggagcccaagccgggtgctggcacatccgaggcgttctcccgactctggaccgacgtgatgggtatcctggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagaaccctcttcataaatcaaactcagaagacagctctgtaggtcagtaccacttttcttggtttacctatttaattatttcaatactttatagaaaacacgaatatgtgaaaatacaaaacccacaagaatccttctactcagaaataaacactgttaagattttgatgtacatccttattctcctttttctaggcagttttaaaaaaatataattgtgatcatattctgcatactgttttatagtttttaacttgaatatgttatgagcattttcccatgactgaatattctctacgttaatacagaaaaattagaagcaacctaaatatccagcaaagaatgaattggttaattagcttatggcacatccaatatggtggaatattatgcagacttaaaaatttactgctgctataaaaatcctggggtctgtgtccctaataatgtccttaggataaatccttcaatttggaattttttggatccaagattatgcataattaaggcattgtatgttttatatattcttgattataaaattcactcttggtttagtaacagctattttg

SEQ ID NO: 47001 - DNA, 372 bp, Homo sapiens
aatcacctactgcctctcgcatctctcttgggaaaaaggtgaaatcagtgaaagagacgatgagaaagagaatgtctaaaaaatacagcagctctgtctctgagcaggtatgcagctacctggtagaatgttcccttggttcttcctgacaagaaaagctgagaatggcccttctgagattttaaatggtgctaaatacacatactccttggcattaacctgctccaagtccgtgctttatttacgtagagaaacactgaattcaacacacgtttattaagcactttgggctgctcagcaccgtgcttggtgctgggaatacaaaatacagaacttgccttctgtgtacagacaagagagacagacatgtaa

SEQ ID NO: 47002 - DNA, 4743 bp, Homo sapiens
attttgaagagaggggtcccggggagctccctccaagatctagaggctccgcggccacccctgccgggtcctgccaagacttgctagaaggaacgagtcgcgtgccttagttagttggttcccgtcacaggaagaaacgcctttgcagtgggtttaattgcttctgggccgagcgaattccccgccgtacaactcagtggtgcggactttgcctcctgctaccctgttgctgcgccgagcggggtgggaaagtttctggagttgtcagtcgcgcagcccgtggccacctagacccgaggtgcgggcgcctgcgaagggcccccgcggggtggccggggccgccggggcatgcagcgcgggggcgcggctcggtgacgccgcgggcggggacccggcatccgggcaggctgcgcgcgggtgcggggcgagggcgccgcggggactgggacgcacggcccgcgcgcgggacacggccatggaggacgcgggagcagctggcccggggccggagcctgagcccgagcccgagccggagcccgagcccgcgccggagccggaaccggagcccaagccgggtgctggcacatccgaggcgttctcccgactctggaccgacgtgatgggtatcctggacggttcactgggaaacatcgatgacctggcgcagcagtatgcagattattacaacacctgtttctccgacgtgtgcgagaggatggaggagctgcggaaacggcgggtttcccaggacctggaagtggagaaacccgatgctagccccacgtcacttcagctgcggtcccagatcgaagagtcgcttggcttctgtagcgccgtgtcaaccccagaagtggaaagaaagaaccctcttcataaatcaaactcagaagacagctctgtaggaaaaggagactggaagaagaaaaataagtatttctggcagaacttccgaaagaaccagaaaggaataatgagacagacttcaaaaggagaagacgttggttatgttgccagtgaaataacgatgagcgatgaggagcggattcagctaatgatgatggtcaaagaaaagatgatcacaattgaggaagcacttgctaggctcaaggaatacgaggcccagcaccggcagtcggctgccctggaccctgctgactggccagatggttcttacccaacgtttgatggctcatcaaactgcaattcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcgagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacctccaaagacaagacaagcacttatttttattttcagaagacaaaagaaccaagatgccaactggctgcgaatgctctatctccagtctgtctctgtgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaa

SEQ ID NO: 47003 - DNA, 4248 bp, Homo sapiens
tctctctgtaatgtttgatacttgagggaaaacagctgggcctgagcatgctgactccctgcaaagtgcaatgggctgctggggaatatggactgtactgtatggctgaaaggtcagctttttcccttgtctctcttggaggaatgcagggtctgtcctcacattcgccttgtgagcccttagaaggagccgggagaggcggaagggctggctgcaatgtggcagacagtcttagccaatgggatggaagaggctgtttgcatctctttccctttcctgccctgctgtttttgattttcgggggagggctggaaaaagccaacagaattttggtttggagaagtagttgatgaccacgttaaacagcaagccctgatgggccagacagatgagagcctggcccaaaccacagcagtgaaactggaattacagggccagcatcggagggagagtcctgctggagtcctcctaagagaggacaaggaagtagttgagacagatgcccccacaggccacttgcccccacttgcccttgagggcaaggatgtgtgtttccgtgcctaggacctaattctacgccgatttagatcttaagatggtatgtggcactttgtaaacctcttgggcaaatttttgttggttcccaagttcagcaacagagctgccgaggttcagactggcagcaaggccggctacatccaagccacacgggcaaagctcggagcaattacctgattaactttttcctttgtttctttgccagtcaagagaacaatcggatgatgagactgaggagtcggtgaagtttaagaggttacacaagctggtaaactccactcgcagagtcagaaagaaactaattagggtggaagaaatgaaaaaacccagcactgaaggtggggaggagcacgtgtttgagaattcgccggtcctggatgaacggtccgccctctactctggcgtgcacaagaagccccttttctttgatggctctcctgagaaacctcccgaagatgactcagactctctcaccacgtctccatcctccagcagcctggacacctggggggctggccggaagttggtcaaaaccttcagcaaaggagagagccggggcctgattaagccccccaagaagatggggacattcttctcctacccagaagaagaaaaggcccagaaagtgtcccgctccctcaccgagggggagatgaagaagggtctcgggtccctaagccacgggagaacctgcagttttggaggatttgacttgacgaatcgctctctgcacgttggcagtaataattctgacccaatgggtaaagaaggagactttgtgtacaaagaagtcatcaaatcacctactgcctctcgcatctctcttgggaaaaaggtgaaatcagtgaaagagacgatgagaaagagaatgtctaaaaaatacagcagctctgtctctgagcaggactcgggccttgatggaatgcctggctcccctccgccttcacagcccgaccccgaacacttggacaagcccaagctcaaggccgggggttctgtagaaagtcttcgcagttctctcagtgggcagagctccatgagcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacagactcactcaagctcaagaaaggagatatcatcgatataatcagcaagccacccatggggacctggatgggcctgctgaacaacaaagtcggcacgttcaagttcatctacgtggacgtgctcagtgaagacgaggagaaacccaaacgccccaccaggaggcgtcggaaaggacgaccaccccagcccaagtctgtggaggatctcctggatcggattaacctaaaagagcacatgcccactttcctgttcaatggatatgaagatttggacacctttaagctgctggaggaggaagacttggatgagttaaatatcagggacccggaacacagagctgttctcttgacagcagtggagctgttacaagagtatgacagtaacagcgaccagtcaggatcccaggagaagctgctcgttgacagccagggcctgagtggatgctcaccccgagactcaggatgctacgaaagcagtgagaacctggaaaacggcaagactcggaaagctagcctcctatctgccaagtcatccaccgagcccagcttgaagtcttttagcagaaaccagttgggcaattacccaacattgcctttaatgaaatcaggggatgcactgaagcagggacaggaggagggcaggctgggtggtggccttgccccagacacgtccaagagctgtgacccacctggtgtgactggtttgaataaaaaccgaagaagcctcccagtttccatctgccggagctgtgagaccctggagggcccccagactgtggacacttggccccgatcccattccctggatgaccttcaagtggagcctggtgctgagcaagacgtgcctaccgaggtgacagaaccgccccctcagattgtacctgaagtgccacagaagacgaccgcctcttccacgaaggcccagcccctggagcgagactctgctgtcgacaatgcattgctactgacccaaagcaagagattttctgaacctcagaaattgacaactaagaaactggagggctcaatcgcagcctctggtcgcggcctgtcaccccctcagtgtttgcccagaaactatgatgctcagcctcctggagctaaacacggtttagcaaggacgcctctggagggccacagaaaaggacacgagtttgaaggaacacaccatcccctgggcaccaaagaaggggtagatgctgagcagagaatgcagcccaaaattccatcacagcctccacctgttcctgccaaaaagagcagagaacgccttgctaacggactccaccctgttcccatgggccccagtggggccctccccagtcccgatgcgccatgcctgccagtgaaaaggggcagccccgccagccccaccagccctagcgactgtcccccagcactggctcccaggcctctctcagggcaggcgcctggcagcccaccaagcacaaggccgcccccctggctctcagagctccccgagaacacaagcctccaggagcacggtgtgaagctgggcccggctttgaccaggaaggtctcctgtgcccggggagtggatctagaaacgctcactgaaaacaagctgcacgctgaaggcatcgatctcacggaggagccgtattctgataagcatggccgctgtgggattcctgaagccctggtgcagagatacgcagaggacttggatcagcccgagcgggacgtcgccgccaacatggaccagatccgggtgaagcagcttcggaagcagcaccgcatggcgattccaagtggtggactcacggaaatctgccgaaagcccgtctctcctgggtgcatttcgtctgtgtcagattggctcatttccatcggtctgcccatgtacgccggcaccctctccaccgcgggcttcagcacactgagccaagtgccttctctgtctcacacttgccttcaggaggccggcatcacagaggagagacacataagaaagctcctatctgcagccagactcttcaaactgccgccaggccctgaggccatgtagccaggcccggaatgggcctctctggacaagagccaccctttcactgtgcatatgatgctgatgcaattcctccatcatctctggacgtgcagaccagatccagaagaaaggcctggcgtgtggccaaacagcgtgaaaccttggcacaggactgaggatcctctcctccagaaaagccccctcgaggaaataaattagtgcggttctctttgacctccaaagacaagacaagcacttatttttattttcagaagactgtactggtagaggctgggaggagtagggggcagcctgttccatttctgatagtgcccttgctcttctgtctgtcatcttgcaggatgcccgagggccagatgggcttagctaggccaaagtaacagactcaagagttattgtacattactgaccacgctcatttgttcaaaagttagaacatctggctgcaccaggaaaaaaaaaaaaaaaaa

SEQ ID NO: 47004 - DNA, 197 bp, Homo sapiens
gaaatctggatctacccgtgttcttcctatgtttcctgtacaggcggtcaaacagtgagcaccactgattcctcaaccagcaaccgggaaagcgtcaagtcggaagatggggatgacgaagagccgccttaccgaggcccgttctgcgggcgtgccagggtgcacaccgacttcacccccagtccctatgacacaga

SEQ ID NO: 47005 - DNA, 2102 bp, Homo sapiens
gtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaatacattttcaacca

SEQ ID NO: 47006 - DNA, 1265 bp, Homo sapiens
gtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgagtcccttaacaaggctccacagatcagctggctttcaaaaagcctggaagggtgccccactcaggaactcccaagagaaaccatcttgtccctcagccaggctgggactgccagtgaggccatgctgagccagtgcaaacccgtggctgtggttccacaagacaacctggtctgtgctgtccacccag

SEQ ID NO: 47007 - DNA, 1285 bp, Homo sapiens
tcatcgaaaccctgtcatcgaaaccctaaacccgtatacaagtagaccactacgccaattaacgcggttatttggggggccttcttatattgcttgtagtaacctgagggtttgatgtcatcgaaacccttcatcgaaaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaatacattttcaacca

SEQ ID NO: 47008 - DNA, 2080 bp, Homo sapiens
gtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggtaagggaatgctgtcgggataccgagcttgaat

SEQ ID NO: 47009 - DNA, 2020 bp, Homo sapiens
gtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagaacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaatacattttcaaccaaaaaaatacaccgaaaaaaaa

SEQ ID NO: 47010 - DNA, 1661 bp, Homo sapiens
gtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttcatgccactgccattaaaggagctgttcatgccactgccataaaggagctgttcatgccactgccattaaaaaagcgtggcgactc

SEQ ID NO: 47011 - DNA, 283 bp, Homo sapiens
ctccctcagccctgcactctggaccttcagtattctttccatggccttctgcagtcaggcagtccagacaccaagaggcaggggcaaagaagagcatgggaggggaggctggccttgtagtcactgaagcctatattcaggtttgccaggctggcctagcagtcaccctccttgcttcatctaatcaccctttatttttactaacaccatcattaagcccccctcagccttcccacccaactgagaaatccaagaaactttcatctttccccacaggctagtt

SEQ ID NO: 47012 - DNA, 284 bp, Homo sapiens
atttttacagcaccctcggaaaggacagatgtctgtagtgacctggctccaccctggccataccctccatcaagggctgtacattcaagcctcaggcataggagaggaagacctgctgctcttctaaggagatgtccatcccttcagacaaatttcaacctttagtaaatgagcaaaactgagagaggaaatgctcaacatttattcatataaacttttatctgtaactctgcaagctttataagaagtatatgcataatccatgctcattacataaaaattaa

SEQ ID NO: 47013 - DNA, 509 bp, Homo sapiens
gtttgatttgcagagttggcagctgcaaacagttcgatctctctagtcccggctgaggaggagaaacagcgcctgcaagcttggcactgtacacctggggttggggacaggacatgactaagcacagagctttcttcttttgaggccacgcatgtggtgcggagcgggaccacctgcatccacacagcccggcgcacctgctcctacttctgcttagcgtgtgagcagtgtggtgaccagggtctccaccagggggcaggccaggaccgcctcacagcactttctaggcgctctctggtcccgggctgggacacatacagggcttagtaaagttcgtagatggtagctcggcagccccaggccccaggtgacacctctcccctgcctgccctgtactgcctgcctgcagcactcctgggagtcttgtacgaagacaaggagagacaggacttcatcttcaccatctaccactggtggcaggctgtggccatcttcactgtgtacctggg

SEQ ID NO: 47014 - DNA, 278 bp, Homo sapiens
acctaaaaaatatatatattctgaataatgtgtcccttgatgaacaaattaaatgacttttttctatcaaattggaaaatatttggaattatgggcatccttactatcactaaatatttggcagtgagagtagaaattggtacaacaggggttagggagggagagcatcaggaagaatagctaatggatgctgggcttaatattaataccaaggtgatgggttgatctgtgcagcaaaccaccatggcacacatttacctgtgtaaaaaacctgtaca

SEQ ID NO: 47015 - DNA, 428 bp, Homo sapiens
gttgtttaaatgtgcccatattttgctctttctttgacttctatagactaaagttggcccagctttggaaactggtataactccgttgtcattaacaactgaggtctaaagttaagagaacacagaggatttttagggcagtgaaattattccatatgatactaaaatagtggatacaggtcattatgcatttgtccaaacccacaggaggtgtaccaccaagagtgaaccctaatgccagctatagatttggggtgattatcgttgccactgaaggttcatcaagtaacaaacataccactctgtggagaatgtcgatgatgggcagtggggggtggaatgcatgtgtgggggcagaggttatgtgggaaatctctgtaccttcctctccattttgctgtgaacttaaaactgctctaaaaaaaata

SEQ ID NO: 47016 - DNA, 432 bp, Homo sapiens
gatttttccctaaatcaatggttgttctagaattcatattcttctcatgcttttgacactacccactctatcttcaagccaacaagagtaggtcaaatcttcctcatactttgaatctccctgatttcccttccatcttgttcttctgattttaagggctctgtaccactagctgtgtatcgttgggggtcatgtaaactcttttttctttctttctttttttttttttttttttcgagatggagtctcactctgtcatccaggcttgagtgcagtggcacagtctcagctcactgcaacctcagtgttctgggttcaagcgattctcctgcctcagtctcccaagtagctgagattaacaggcacacaccaccacgccaggctaatttttgtatttttagaggtggggtttcaccatgttggtctggctgg

SEQ ID NO: 47017 - DNA, 323 bp, Homo sapiens
aagtcataaaagctgtaataatacaaaggtctggataaagaactagctacccttcaaatccagcagcagcttctttggtcacaactgtataacagcacaagacagtattgatttttataattttctcacctcaagtaaattgcatttgatatattctgtctttgaaggtagaaaaatgtgtgccgtgttttagaaaggtttcctttggttcacctggcacggtggcccatgcttgtaatgtcagcatgttcggaggccaaggtgggtggatcacttgaggtcaagagtttgagaccagcctggccagcattgttgaaacctca

SEQ ID NO: 47018 - DNA, 893 bp, Homo sapiens
gtgatttttttttcagtatacctagcatttattcaagaattctggtttattttggaagctatgtaatgacctgtccttactccattgttcttcctttttaactgttctcttcccattaaaaaaaattcttcttttgccccctaggtgattagagaaaattgatgagcatactgtatttgaaatttagctaggtgtttgaggcagacccagtggtattcttgtggatagggcaaatcaggctggactcatagctcattgacagagggaagccatggagcattaaataatggactcgtgtctcttagggtagatgctagagatgtatgtcaggggtcttagggacctcagtgctgtcctgtcgaaccttttaatgactgacttggatggctataccgaaggatgggtttatcaggtttgcagacagcaagaaactagaagggatggagtgtatgttaaggtggaaaagaaactgctattctagaagttcttgacagacgagagagaagggcagagtctaaaaatacaatatttaggaaggaaggattaccataagaaaattggacccatatacccttttgcttaagcttataatttgggcagtggatataaaaaagaattagaggctgagcatggtggctcacacctgtaatcccaacacttcgagtggctgtggcgggaagattgcctgaggccaggagtttaagactagcctgggcaacatagcgagaccccatttctacaaaaaatagaaactagccaggcatggttgtgtgtgcctgtagtcctagctaccggagaggttgaggcagaaggatctcttcagcctgggagttcaaggttgcagtgatttgtgattgcatcactgcacttcagacagagcaagaccctgtcaa

SEQ ID NO: 47019 - DNA, 513 bp, Homo sapiens
ttacaaagttgctatgaactactaatgttatttgattttttcctcacaaccttcaagaggaggtgatcattctttctctccattatacagatgagaagaatggagactcagaggggtcaagtgactcatccaacatcacacagccagtagttggagtgtcaaaccttaaagagtggggatgtgtgagctgaaagtgactttagggaaacttctaaggttcagaggacatcagcatcacctgggacccctgagtgctgtttcagctctgcaggtgattctgatgtactaaagttgaggatcccagccctttattttatagtcgggcaggtgaggaccagacaggggcttgggtggggcagagctgggcaggaatcaggtctcttgtgggaagtcttgagctgtgtccagctctgcgctgtttcctccttggttcttcatctattttgggagaagtatcttcatctgtctggagtgggacggggaattgccatttttttcagaaggttttaattt

SEQ ID NO: 47020 - DNA, 470 bp, Homo sapiens
tttttccccaaaaaatttgctactcttgaggttctgtcaaagaatgtgctgtggcctctagaagcatttttaaaaagagactttcacaagtgattgtgcaaaattgtgaggtcactgaataggtgtgtatcctcctaaggaggtagcgttggaggagctgttcttgttcaatttactcagcacctgtgaagaggcttcactgtgatttgcctgtacaggtgtgcaggtaaaaatctaagttccacaggtagtgcaaaaaaatctacctccctaggtacctcgtacatttatcacagtttcctggtaaacagttctgctgttgttgacaaaattttatcagaaacattgcatactcttctctaaatagtagtttccctacaagtgggctgtcttcagtttagtcgtttaagttatgttgacataaatgattatgtgtgtggcaggggcttttgcgtaggttgttgaaacat

SEQ ID NO: 47021 - DNA, 427 bp, Homo sapiens
catgatgacggttgtagctttgctaaatatagccaaatctagaattcagaaatgaagtccagaataagcaattgccatggtcaaactctttctttcagtctttctaacaaagtaaagctcatttaataacaaataatgatgaagagagagcagcagtttcacgtgacttttgagtgggagggtatgaggggagacatacacttgtaccctggtagctaaaacgccatgtagagtacacaagaaaggtttgataaatattaacaaaacacacaaaaaatattactgcatcagagccgtcattttaacttgcaatatttgaatgttgacgcttcggaaaggggactagtaccaccttcatcttgcaccctttcaaggatgcatgccttctgagcctacttatgaggtaactgtgacatccgcatctgaa

SEQ ID NO: 47022 - DNA, 363 bp, Homo sapiens
cggtgagttacatgtggcatttgatgctttttttcccactcgcttcaaagtggaattctttgctgtgcaacaccacacgactctcctagcgtatctcagccttgaagtgttcactaaaattgatatcgctcttccctgaaagaagcaagtcgtaaacattgtcttgtttaaaattaaaaatctacagtgaagtgcttaccgcaagaggaatgtgtctcaaggttgtctctaatgcgcttgacattccgtgttcctttaccgaatgttcattgaacccaggctggggtcggacgaggctgagggaagaagccagcctgagggaagaagaaaggttaaagagagacaggaaggaggaaggcataa

SEQ ID NO: 47023 - DNA, 451 bp, Homo sapiens
caggagctgaattctgaagcctgagctactgagaatgctgataaaagatgttataaggactgtgttggaacctgctgtgaccaccccgcttcataatgttataacatagcaattcagaatagtaacgtatgcccctcatgaaaagccaagcagtgcaaaaatccactccaaaaagccagactccctcccagcactgagccccagcttctgtgttcccctctccaaaggcagtggttgttattagttacttgcatatcctgttggatatgtgttttctatcagggataaactatacagatatgcacttacaaacatatcatattatttatccttgacagaaaacacaagtgaagtttagccgacgatatacattgtcctacaccttgtattttagatctaacattgccttctagaggtcaacagtacacatgaaagtgcctacgtcttttca

SEQ ID NO: 47024 - DNA, 460 bp, Homo sapiens
taagagtcttgtcaattttcccagacaggacgctgaagctagagataacatattttttaggaataaggtaaaccaggccacctcttgcagaacacagagcacctaactcaggtgtgggccatggtggagccgaggtcaacaatggctgaccagcacactccaggacattccatagtggcttgctctttcctcttcttctgctttcagaacaataacctgccatcctttttatttttcaaacttgactgattctaaacaaaaataccaggcagttattttcatatttcatagctcagggtcacttaaattataattaatttttactgatcccatcatttcaaattcatcttagggaatttaacaagaaaaggtctaaatagatttttttaaatatgttaataaggatcggtacatgtcgaatctctaattacctgtgtattatctctgctcagtcttgagt

SEQ ID NO: 47025 - DNA, 231 bp, Homo sapiens
ctcctgtttcccaagccttaacatgattaacttgaagagtctacaactcttccactgttaataatagtcaaggaggaagtcatagacagttttatagacccactcataggtgatttggtaggctccaggtcacacaggacactggctacttgagttccaatcacagctactctaccattgttgtaaacatattttaagcaagaggaacatacagccatcaaaaggacaact

SEQ ID NO: 47026 - DNA, 409 bp, Homo sapiens
gttatgtcaggaattcagaaatgcctcgtgagtgactgttgtcaagatggatagaaatgagagtggtcctcacagccctggtcaggtctctacgatctcacttatttagaatcaaagttggacattagcccgttttcgcctggagaaacaatttcgctctgggaactgggggctgtaccttgtatagactcgagtagtatcaaaagacctgaacaaactatatagagtggacagagccttacttctgatgttcaggccaccaggcagtggttggagggatggctggacacagccatatccctctgaaagcatatttaaaacagcccttatggcgttaataccatctatgtttcaggtaagcctaatgagaaaaagatcaaaacgttgccctcaatcttctctattcaaa

SEQ ID NO: 47027 - DNA, 363 bp, Homo sapiens
aggtacgcatacttccacctactagacatgggttgaggggtatggaaacacccagaggcctaactacctcttgaggcatgggtgtccttcagatcaaacacgcaaaacgggagcccagattgctggcaatcacgctcggggagcttgtgtgccaggttgggatggagaactcagcggcctccacccccttgtcgttgacacccttggcgccactgtgattccccagctctccaaggctgggcacactctgtgggaaatggaatgcttagcttgagctgttgtgggaaggcactgagggatgttcgtggcaccctttttcacaggatgaagggatcaaccaggactgccagtgacaaatgggag

SEQ ID NO: 47028 - DNA, 301 bp, Homo sapiens
tgctgttcccagtgtccgtgggtctcattctccagatctgtgatttctacgtgaagtgcaggatccaggctaagaggcagacacaaggccttgttcctcttcttgaggcattggaacccccaggcaggtctgcctattttattccaccctgccacagctcccagaattgtctcccacaaacatggttttgatgacttatctccactgcccaaagaacaaagcctctgctgttgcagccagctctggccttaccttccctacagcgggtcctcagttgacatggtgctggtagggtgactct

SEQ ID NO: 47029 - DNA, 582 bp, Homo sapiens
cgcaggcgcccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcaccagaccacggagcttctggccaaggcttcaccaacttcacttgatgctgtgaggaacagaactgcccatccaagccctgccagaatttctaacccacaaagccacgagtcacaataaatgctatgggacaaaaacagtcat

SEQ ID NO: 47030 - DNA, 1128 bp, Homo sapiens
accccttctatccatccccagtgctacctcctaattgaggtcctcgacgctttttgcttgcatggctgccagagcctttgggcaggtctctgtgttgatgtgttcacccccactcctatctcctccatccaacgctctaccaccaaggcaatcctcctaaaacacaaccacagtgttcttcacactccctatgattccctgccacccacattattaatcattaatccaattaataaaaattaatgtactaatccccagctcctcagtgtggcccttcacaatctgcttgtccagcctcgtctcttgcctccccagctttccccagcagacccctctcccacccattccaatgccatcctcttctcccagcctagttctttcaggccctgtgcgtttgcacttgcccctgtctgaaatgtccttcccacttcttcttgaagggggtgagtgccaactcacctttccaaccccacaccaatgcacaccaggatctccccaagactccagggtagtagtcaccatctgtatttctgcagcacactgcacctgcctctagcacagctcgacagcccactgaagtgaatgatctgttcgatcggtgccgacttgcctttctttcccagctgcaaaccacccaaggtgaagtcatcttagcctcttggagtcagcctgactggggtgaacccattgatctgtattgcataaatgaacatatcatgacagtagtgatgagcgatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggaaaaaa

SEQ ID NO: 47031 - DNA, 632 bp, Homo sapiens
gtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccccaggatattgtggctggagacatgagcaagaaaagcctctgggagcagaagggaggctccaagacctcatcaacaattaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggaaaaaa

SEQ ID NO: 47032 - DNA, 503 bp, Homo sapiens
caggaaaatgggacctcttttctgaaatccacatctttatatgtgctgtttagttggctggaaattcttgttacttatcctattgagaagtggcctatgacctctttctttgaatctagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcaccagaccacggagcttctggccaaggcttcaccaacttcacttgatgctgtgaggaacagaactgcccatccaagccctgccagaatttctaacccacaaagccacgagtcacaataaatgctatgggacaaaaacagtcat

SEQ ID NO: 47033 - DNA, 660 bp, Homo sapiens
cgcaggcgcccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaaggatattgtggctggagacatgagcaagaaaagcctctgggagcagaagggaggctccaagacctcatcaacaattaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcaccagaccacggagcttctggccaaggcttcaccaacttcacttgatgctgtgaggaacagaactgcccatccaagccctgccagaatttctaacccacaaagccacgagtcacaataaatgctatgggacaaaaacagtcat

SEQ ID NO: 47034 - DNA, 659 bp, Homo sapiens
gtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccccaggatattgtggctggagacatgagcaagaaaagcctctgggagcagaagggaggctccaagacctcatcaacaattaagatggactctgtgactacatgactaataaaatatggcagaaatgacaccatgcagtttccaagcccaggccttaggagacaggcagcttccagttcagtcttttggagggtcagctctggggccctcagccatcacgcatggagtccaaccaccctgagacgtcatgctggagacccacctgtggatgccccagtcaagagtcctggctgagcccagcctcccagccacccccacccaaggcaccagaccacggagcttctggccaaggcttcaccaacttcacttgatgctgtgaggaacagaactgcccatccaagccctgccagaatttctaacccacaaagccacgagtcacaataaatgctatgggacaaaaacagtcat

SEQ ID NO: 47035 - DNA, 555 bp, Homo sapiens
cgcaggcgcccagaggcgcacaggagacctcaggcccagactccactccccagctgtgaaaggactgctggccagacccccaagctagcccgccaggcctccatagagctgcccagcatggctgcatccagtaccaagagttggtgggagacgggtgaggtacaggctcagtctgcggccaagactccgtcctgcaagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggaaaaaa

SEQ ID NO: 47036 - DNA, 820 bp, Homo sapiens
  misc_feature (196)..(196): n is a, c, g, or t
  misc_feature (232)..(232): n is a, c, g, or t
aaaacaacgaacacaacagatcaaaatcggccggcgacggaaaaaaagtatccatacctgcaggcactagcaacgcatctcgcccacggcccaccaggctaacagtgcataaaacagagctcctccacaacaacgcaacaaccacagccacccatcaaaaaaaacacccgccgaaaggggcgtggtttgcacccgnaacaccatcaaacacaggaaataagcaaattaatanaacccgaggcatggcctctcgactcaatagcgcactaactagacggaactgatatataaaaaccaacagccctacactatatgatctcgaagatgcgaattcaaacacacaattacccagatcaccacaaaaaaaaaacccaacatgtacggaacgccgcaatacgaaggaaacaaccgcaaaaacacatgatcatcacgaaggcgggaacccaactgccttgctccggcccatgccctaaaaaaagagataaaaccaagactggtctaacgtaggcgtaactctggggccctcagccatcacgcatggagtccaaccaccctgagacgtcatgctggagacccacctgtggatgccccagtcaagagtcctggctgagcccagcctcccagccacccccacccaaggcaccagaccacggagcttctggccaaggcttcaccaacttcacttgatgctgtgaggaacagaactgcccatccaagccctgccagaatttctaacccacaaagccacgagtcacaataaataccgatgcgtccgaaagtaaaatatgaagaaacgaacacgtgttaccaacaccgcgcc

SEQ ID NO: 47037 - DNA, 920 bp, Homo sapiens
ttatggtagcagaaggacaaagacatgtttgaaaaatttttaatattgtataaaatgatgatattttcttagtggtcttgttgttgaatccagagattgtggtcatgtagttcataggtaatttatcagttattatttattttttaaagcttttatttatttatttatttattttagagatgaagtcttgcaatgttgcccaggctggcctagaattcccgggctcaactgatcctcctttctcagcctccctagtagctgggactataggcacacaccactgtgcctgtctaatttgtcaacttttaaatgagatcatctgcaagttcaaggaagttagataaagggtgataccacagaaaaaaaatgagatttttctctttaagatgaatattgaatttagaattccttaattaatattgaggatcacatgcgagctacagatagggaatattgagtatttaaagcattctgaatgacctgagtgttttccttctcatgcttattaaaaacatttaccacttacagctgaattggaatatagttctacataaattgttatttacacctgatacacagaaagaaatgtgtttccttatttatcatactattaatttgaatgtgctattctttttttaattgctttaaagtcaattggggaatcagattatgaatatctattttactgcttccacatttcctaagttaatcaaatacgacaagttagtgagcttgtggaatttacttgaatttcctaatcttttaactgagagggtattttcgacagcaaatattttgtagcatccatttgtcattttttaaatattcaaactagttttttttgtatcaataatcttttttggttggtcgttgagaagagtcttgctctgcacccagctgaagcgcaatgcgtgactcct

SEQ ID NO: 47038 - DNA, 859 bp, Homo sapiens
aatatgagagctagagtacgagggagtacagtccataagatgacccttgcttctaatactagttgcaagtttgggggttcccaagaccactctttttttttttgagacagggcctctctctgtcacccaggtgagagtgcagtggcatgatcacggctcactgcgccctgaattcctccctcccaggttcaggcagtcctcctacctcagccacctgagttgctggatctgtgggcacacaccacctcgcctggctggtttttctatatttttgggagacagtttcaccatattgccaggctggtctcaaactcctgagctgaagtgatccgcctgcctgggcctcccgaagtgctgggattacaggcttgagtcactgtgcctggccaagaccactcttaggttggatgatttgccaggaggactcactagaactcattgaaagctctcatacccatggttagagtttattgcagtttagggattcagattagaacgagccaagggtagaggtgcatagggcagagttcggggaagttccaaatgttggagtttctaattgtcctgtccctgtagagttgtgaaaaatgacaccttcctggtggcactggtgtgcgaccatactcatggattattgccaaccagggaagctcactctattttttatgtccagcgtttttactggggttccatggttgcatgcccatgtggctaaccttagtctccagccccactggaggccaagctgatccatgtgactcaaagcccccaccataagccacattattagactgtgctgtggcctaaagcccccagatgaacaaggacactttcccccaccgccgcccccccccccctt

SEQ ID NO: 47039 - DNA, 389 bp, Homo sapiens
cattcatgggatctatggcgcactctgtgctagggcagaatgccagggaagagctgcctgtcttcagcgcccttgctgggaaccacacgccagaacccgaccctgccatgctttgtgcttcaggcagcaggaccccacccctaacagagtctcaagtcagacactaagcgatgatcacgacttgggaactcagccaggaaagaaaagacatacagcttgaaaacaatgtgggaaatggctgagaaagagaggaagataagaaataaagagggctctctgaagagtgagctgaactttggttgtgacaggttctcaatagtaccaaaatccatgaactttttttttgaggattcaaaaaagtttataattaaagagaaatgcttctaatt

SEQ ID NO: 47040 - DNA, 238 bp, Homo sapiens
tgcccatgatgagatatgccaaaacagtaaccttgaaaaatattctgggcacctaggccaaaggtggtcaacctcagaagcaacatgctgagaagcagtctatacagagtaagcacctaaaagatcagctaaattaataaatacattattacattaatgaaagactagagattcatttggtttttaatatttcaactgagtaaattctttgttgtgattatgttattttaaccttcag

SEQ ID NO: 47041 - DNA, 756 bp, Homo sapiens
gtttatagtttgactctggaacaaaattggtaatagccctttcccgaaaagaccctcttcttgcctggggaccagtctgcctttgtaggactaacaaataagctacaagattagaaattaccatttaggtaacttcagcctctggctgcaagagtctgaaactccccaaattgctccttgggataacatcactattataaaatctaagatcagtgcttgagatattttgcagaccccgtacttgacggatcagctgacactacccagaccagtaatctggctcaaccagtcctgcgatcccacccaggaacagaagacagcaagaaaacctcacttcaacactcccgtcgatgactccatcgacctcaggaagctccaaccaatcagcactccccacttcctgagcccctacccgccaaattatctttcaaaactcggatcccctaatgctcagcggagactgatttgagcaataataaaactctggtctcctgcatagctggctctgtgtgaaatactctttctccactgcaattcccctgtcttgataaatctgtctaggaagacaggcaaggtgaacccattgggtggttacacactgaccagccggatttagggagagttctcactaatccacagttctgatgcagccacccctgggggaccctcctggttactgaatctcccactgtctcacagagtctggaagtcacatccccaacaagggccttggtttctctcattgaaaaaagaagg

SEQ ID NO: 47042 - DNA, 631 bp, Homo sapiens
cccaggctgatctcgaactcctgagctcaagcgatcctcctgtcttggcctcccaaagtgctgggattacaggcgcgagccactgcaactggcccattaaatttttaaccccgtacttgacggatcagctgacactacccagaccagtaatctggctcaaccagtcctgcgatcccacccaggaacagaagacagcaagaaaacctcacttcaacactcccgtcgatgactccatcgacctcaggaagctccaaccaatcagcactccccacttcctgagcccctacccgccaaattatctttcaaaactcggatcccctaatgctcagcggagactgatttgagcaataataaaactctggtctcctgcatagctggctctgtgtgaaatactctttctccactgcaattcccctgtcttgataaatctgtctaggaagacaggcaaggtgaacccattgggtggttacacactgaccagccggatttagggagagttctcactaatccacagttctgatgcagccacccctgggggaccctcctggttactgaatctcccactgtctcacagagtctggaagtcacatccccaacaagggccttggtttctctcattgaaaaaagaagg

SEQ ID NO: 47043 - DNA, 3527 bp, Homo sapiens
  misc_feature (1007)..(1007): n is a, c, g, or t
  misc_feature (1633)..(1633): n is a, c, g, or t
  misc_feature (2044)..(2044): n is a, c, g, or t
  misc_feature (3527)..(3527): n is a, c, g, or t
ttttccgtgaagtcaagtccaagtaacatccccgccttaaccacaagcaggagaaatgaagcacattatcaactcgtatgaaaacatcaacaacacagcaagaaataattccgactgtcctcgtgtggttttgccggaggagatatttttcacaatttccattgttggagttttggagaatctgatcgtcctgctggctgtgttcaagaataagaatctccaggcacccatgtactttttcatctgtagcttggccatatctgatatgctgggcagcctatataagatcttggaaaatatcctgatcatattgagaaacatgggctatctcaagccacgtggcagttttgaaaccacagccgatgacatcatcgactccctgtttgtcctctccctgcttggctccatcttcagcctgtctgtgattgctgcggaccgctacatcaccatcttccacgcactgcggtaccacagcatcgtgaccatgcgccgcactgtggtggtgcttacggtcatctggacgttctgcacggggactggcatcaccatggtgatcttctcccatcatgtgcccacagtgatcaccttcacgtcgctgttcccgctgatgctggtcttcatcctgtgcctctatgtgcacatgttcctgctggctcgatcccacaccaggaagatctccaccctccccagagccaacatgaaaggggccatcacactgaccatcctgctcggggtcttcatcttctgctgggccccctttgtgcttcatgtcctcttgatgacattctgcccaagtaacccctactgcgcctgctacatgtctctcttccaggtgaacggcatgttgatcatgtgcaatgccgtcattgaccccttcatatatgccttccggagcccagagctcagggacgcattcaaaaagatgatcttctgcagcaggtactggtagaatggctgatccctggttttagaatccatgggaataacgttgccaagtgccagaatantgtaacattccaacaaatgccagtgctcctcactggccttccttccctaatggatgcaaggatgatcccaccagctagtgtttctaatagctaggttctatgtgaacagtcttattgtaggggcaacctcttaactttgtgactggacagataaaacgatgtagtaaaagaaggatagaatacaaagtattaggtaggtacaaaagtaattaaggtttttgccattactttcaatgaccaaaaattgcaattacttttgcaccaatctagtaaaacagcaataaaaattcaagggctttgggctaaggcaaagacttgctttcctgtggacatctaacaagccagttctgaggtggcctttccaggtggaggccattgcagccaatttccagaagttaagtacctggacatgcgactccaggcagaagatgtagggtctctgtaagccaataataaattggaaggaatgcattgctgcagctgaatttgtctgtctcccacagccatgtgaatctccaccctcctctttctccctgttagtctgatgtattgatgccacctcagtttcagaaagtaggctgagtataaactataaatgtcaaataacgagcttcgagtttccaatnataaatggaccttctctgttagtcttctttgctcactcagtatcccactggccttaaaaccctttcctgttacatttcctcatgctttatgagcatacatttcaaaggaagaaatgaaaatttaatccatttagttcccatgtggaatacataaaggccagatgaaaattgtcactatttgaagaagctgtaaccaaactatgtgtgttacaatgtagaagtacaagaaaagagccccaacatgtattttaagaaataaagagagagagacagagacagacagagagagagagagagagagagagagagagtgtgtgtgtgtgtgtgtgtgtgtgtgtgtgtgtgtgtgtgtgtgtgtgtgtattttccccatgcttttggactatggggaaaaccaaaccaaagcagacntcaagcaatggtgctgttattatagccccaagtcaaagacctgagggaggcaaacaccacctcattctgcagatgaatgtgaaagcagacccagtcactgggaaatgtcatcctcccatcagccaagatgccagcaatggaagagtggcaaccccagtaggaataaaagaaacataatttgcaagttcattcatttttaatagctaaaaatcagcttaaaggagaagcacatcctgattgtaagtccccactaagttggagggtgacttgaatggggtgaaaggtgaaagggacagaggagagcagtggggcttcagaggccaccaggctcaggatctgcaggatggatggtatcttccagaacaggcaatgctttgccctcaggagaatttcccagagctgctgaggggagaagacagccacacacaggacagaccatttggtgatgggtttgatattagaagtggcagggacaggaacttcagaagcaaaggaggcaaggcagctggagtcaagtgaggacagtggcaggcgtgctttcacatggcctgtcccacagatggaggtgaaaggtgcaccttcttgtcctctgttctgtagaaatccttccctgtttgatccttcccctgccaaatgaactatgttactctaatactaacctgtattaattaatatatgagatatatataagttaatttttcatgaaatctaaagcacaaccctagaactaatttttaaaagtgttatttctaccattgaaaaagtaatgtataacatattttatgtgattaaagtgcgtattctcaataagaggtaacctttttttgatgctgcaatgctctgtgataccacagaggtaagcaatgccacttaacctgtatcataaatagtcccaaactgctcttcctataaaattctgcctttgtcaacagctttgctgtctcctaatcactctcaagctctctgctgtgcatgtgactgttgtcagaaggaaaatcaccaagaaacttcacctctcactgcctttgatttgttgcagttaatctaagaaacaaaatgaagatggctagtctaatggtggatgaaacaaaaatgaagtctgagtgctaattcagagaacttgcaattccagacattttcaattctaggtcttctgctatattccaatcagaacagaagcttcagggctcatagttactgagaaaactcacgtttttctacctctaacttcatatagaattccaaatgaaagcaccaccaaactgcacatatttgtgtgaggaagatcaacaagcttcagacttttcccatgaggacttaattcttttatcaaattacccaatttttaaactgctgtgtggatactgtgagtgttcagctttatcgatgacctagccttggaccagatagctgaaaatgttcaggatgtgtactcaagctgatagtaattctgagccctgtctaataaaaaaggaaggatgtn

SEQ ID NO: 47044 - DNA, 879 bp, Homo sapiens
gtaggggggtgcaagtctgtctccggcacgcgatgatccaggtctttcctctgagtgggtgatagcctgattgtagcttacaggttagagaagcagggcaaacaacaaagtacatgaaaattcaaggccgggtgtggtagtgcatgcctgtaatcccagcactatgggaggccaagtcgggcggatcacttaagttcaaaaccagcctggccaacatggtgaaaccctgtctctactaaaaatacaaaaattagctgggcgtggtggtgtgcatctgtaatcccagctacttgggaggctgaggcaggagaatcacttgaacccgagaggtggaggtcgcagcgagccgaggtcacgccactgcactccagcctgggcaacagagcaagactccttctcaaaaaagaaaagtacattcagcttgctgaaagtgtacttgtggtgtgtgcgtgtgtgtgtgtgtgtgtgtgtgtgtgtgtgtgaattccccgaagcctccataaattaaaactacaaatcgagataaaaatacaaaacattttgatttcattctttgccttctatgcacattaaagggtttggtttagaccaagacctgcagttcattgtgattctatcagccaaaaagcatgagtcatgttatgtaaaatattccacagaaccattgttaactgtgcagttccattacatgaaatcattgggctcatttttcttctgagacatgtttactatagcttattgaaccctgctaagaaaattatagatcatgattcccaaatcggcggaatgaccattatggtctcatcctcaattctgtttgaatttggggcatggtagtccctggtctgtagtgaataaaaaatgaaaaagcttcatgct

SEQ ID NO: 47045 - DNA, 237 bp, Homo sapiens
aattacatatgcagaccctagttacaaataaagtcacatccacaggtagggagtgggtagaatttgagcctatctttttgggaagacacaatttaacccattgtgaccttgttaacagggcaaacaaggtccagaatacaaagctaaagagagaagaaagagagagtttactgtctggccactggtaaaacgaaagaaatcacctctgttatgagacaagctataaaacaataatag

SEQ ID NO: 47046 - DNA, 271 bp, Homo sapiens
aactcaagttgtctgtggattcttgatagtatctcatcagtagctgaaaaaaagaaaaacatactaaaagcctttaatctgatacaaaaagaactagtagttggttgtttaatttaaaagttggtcaaagtaggaaataatttaaaaagatatgtattttaaacatttcaatttaacctaaatatacataaatttcctagtcttttgttggaagtccttttcaagaaagccagtgtaaaccagacttacaatatattgtttctgttttcca

SEQ ID NO: 47047 - DNA, 708 bp, Homo sapiens
ccatacttcccaaggtaatttatagattcaataccataccccctggcacccaccttcatcagaaagagtagaaagaatgaaccaaaccctaaaaagccatctaaccaaattagttttaaaaactcgattatcatggaccaagtgccttcctattgccttattaaaggtccgaactgtccctcagaaagaagttggcttatctccttgtgaaatgctgtataggctgccttactcacacttcactgttgacattcctacgtttgaaactaaaagtcagtttctcaagagctatgtacttggtctctcttccactttctcttccctcaaagctaaaggctttttagtacagatgccacccttggagttcccagcacatcagcatcagcctggggatgatgttctcatcagaagctggaaagaaggaaaactcaaaccagcttgggaaggaccctatctcgtgcttctaaccaccaagactgcagtccaaacaacaacaaaaaaatgcagacccatcataccccagtcaaaaaagcatcgccatcttcaaagtcatgcgctattgttccgagaccaattcctaccaagctaaagataaaaaaaaaaaaagcttaaccctcttatagtgcctttttttctttcccctctctactgtcagacaattatcctttcctcacccaagtaacaaaaccaaagtggccgtcgtagagg

SEQ ID NO: 47048 - DNA, 427 bp, Homo sapiens
atatatttgtttcttccattataaataatcctgcgataaacatctcatctgtttctcaacatatgtttgattcaacattatttatacttatcaattcgatcattgacaaacatcctgctttataagctgtggtagagatacaatgtgggtcctcagaaagctcacagaaaataggctttctcttgctcccttatttcatgccgcctccttggtatacccgctgacttcctgatttctaattactttccctgaccatgattcttacctaatccttgcctatctactgcttttaacatgtgctttttccccatagctgaactaagcttatggatacctaatgtagatgacaggttgatgtgtgcagcaaaccagcatggcacatgttacatggcacatacctatgtaacaaacctgcatattatgcaca

SEQ ID NO: 47049 - DNA, 429 bp, Homo sapiens
tgcatcatgacacagcctagcctgatcaaattcactccaatgagtcggaattctggttacttttcaccttccctgacagcgttgacatcttcaagcacccctcctttaccatccccatcttaaagtgctatggaatgccccgtgagagggtgtaaagaataagaaagtactaaatgtcattattaaccacacagtctccagagcatgtgccctgggttaaagcaactttctgtattttcctccagggaagtttaggaaaacactttttccatgtgctgcccagatctgcctttccagcatttgggaaggtagcggtggtgttgacagtgttatagggtgatgtttccagtaccctgacccatcgtcaaaaatgaacttttgcccaatttactgagaaaaatggctcagtcagggcagactataccaggg

SEQ ID NO: 47050 - DNA, 650 bp, Homo sapiens
tttaatatcactcatttttttctctgttaaagttgtttctattcatctcactttaccactgcccagaccaatcttcctaaattagcagaggcctgcagcaccctgcatggggaaggaaagtgcgggggggcgggaatagacagacagactgtctgcagcaaaactatttaattcgagctggttgccccctctgaaaaatgatgtccacatcagataaggagacgggcagtttaaattgttctatcagaaccgagttgcctgtttttgaagctcattctagacaattgaaaactgttctcttctcctttttcctataacgcaattgcccaacttgaaggctgtttgtgattgaagtaggggccacaataatttatacagtaaaagcctctatctagatcaaattgtatattttctacgtaaatatgctgggtaaatagtccctctgttttatctttaatgcagtatctttatgcattctgtcaagctaacactcctttgggaatattttacatgctagaacacaggcaacttgctacttattacatttaatgtggtttggcttttcgcagatgagaatattaagtgttatgtctgccttccttagaagcagtttgccctgtgaatgtgcatttgttgccctaatgggtctt

SEQ ID NO: 47051 - DNA, 1346 bp, Homo sapiens
actagacagtaactcaaatgcatgaaaaataaacagcaccaccaaaggtaattaaataattataaaaaacagaatagatctatttgtgtaatacttttcttcacagatctatattaaaagacaactggataaggaaataattacaaaatgtgttgatatgcctatattgtgtagagatctaattggtatagtaataatagcacaaaggacggggagaaaatggaaatatagtgaagcaaatttcctatgctattgaaactaagttgatattaatctgaagccaactatttcaaggtaaaatgttaattttaatatcagggcaaacaataaaaacaaaagtaaacacaaaaaaacattaaaaaatgagtgggagagggacttaaaatggtacccaagaaaatagttgtttaataaaaaagtcagtaatgaagacataagacatggggaaacaaatagcaaaacagcagacattagtgcccccctcatcagtaattacaaacataaatgaaagaatactccaatcaaaagacagagcttggcagaataaatatttttaaaatatgatccagctacatattatctacgaaacacatactttagattaacaggcacaaaaaaggctgacagttaaaaaatggaaaaaagatataccaggcaagcagaaatcaagggaattctggagtagctttaattatgtgacaaaataaaaggaaaaataaaatttgccaggcatagtagctcatgcctgcaatcccagcaccttgggaggcagaggccgggaatcgagatcacttgagtccaggaatttgagaccagcttaggcaacatggtgaaattctgtctctacagaaaaatacaaaaaaattgctgggtgtagtggcgtatgcctgtagtcccaactgctcaggaggctaaggcactgagttggagacctcagtatgctttcaaaaataaaactgggcagaaaaagaagaaaatagaagacttaaacaacactataaaaccatatcacctaaacatacatagaaaatccacccaacaaccacagtatacatattattctcaagtgtacatggagccttcttcaacacagaccatatgctaagtcataaaacaagtctcaattaattttaaaacattgaaaccatacaaagtatgttccccataacaatgaaatgaaattagaaatcaatttaaaaaaagcaatttggggaattcacaaatatgcaagtcaggtgctgtggttcatgccaatattcccaacactttgggaggccaaagtaggagaattcctggagcccaggagttcaagatcagtgtgggaaacatggcgagaccccatctca

SEQ ID NO: 47052 - DNA, 485 bp, Homo sapiens
agaagggaggccaggaaattagaccaaaggtagaaatatacaaccggcatggataataataaaaaaaaacaccagaacgtagttcatcctaaagctggctatgaaaaggatcaagaaaaagtacttaaacaacactataaaaccatatcacctaaacatacatagaaaatccacccaacaaccacagtatacatattattctcaagtgtacatggagccttcttcaacacagaccatatgctaagtcataaaacaagtctcaattaattttaaaacattgaaaccatacaaagtatgttccccataacaatgaaatgaaattagaaatcaatttaaaaaaagcaatttggggaattcacaaatatgcaagtcaggtgctgtggttcatgccaatattcccaacactttgggaggccaaagtaggagaattcctggagcccaggagttcaagatcagtgtgggaaacatggcgagaccccatctca

SEQ ID NO: 47053 - DNA, 1052 bp, Homo sapiens
tggagacaattttgcttatctgttaacaaaagttagaggaatcacttgtaaggttggtgggagacccagaatttaaatattttccaaaagatcccattggaatattgcacttttgctctttgttcgtatggatctgtggaggaactgagagctcataataaaattatgcagcaccacgtcaggtagaataatttgagaaacaatcactccctaaacgcagtttgtctttgcctttcatttttttaatttaagaataagttttttttagaaaaatatagagatgtaacccaaagaaaataaagacataatcagatagccctctgattttttgaaagaatagaaataatatatgcgtatcactaaaaaactcaagcagtacagaaacattaaaatgaaaagtggaagttcttcctgctctcatttttgttcttaaaggtgaatgctgttatagtcttttgtgaatctttccaggaaaaacatgcatgcgggaaaatatgtttctgtctatgtgttatttgaaagtgcacactaatgagttgtgctgtgcacacacagacatgagctgaagatctgctctttgcgtaccaccagcttcagctccaatgtacccactttattctcgtgaatggatgtctattaccgaggatttattaaaaacagggtatttgtaaagagggccagcttcgtgctttaaatgaataaagacaggattttgttgtgttcattattggaggaagtacttgcaatggattgtaataacttccctgccaaaggtagctgttttttggcaagaagtaaggaaaacaaaccaaaggaaaggaggattgaggggcaagaggcatgaagttttgcccttcttgaatatgccccgagttgttctacagatcactgaagggcatttgaaggtgtgaggggaaggcttcctctcctttggagggagtcagtctctctgggccaggaaagagacatggaggcagaggggtgcgggaaaaccttgtgtgaagaaatactggctacaaataaagtttagattttcaataaaaaaaaaaaaa

SEQ ID NO: 47054 - DNA, 664 bp, Homo sapiens
atcccctctctactggatcactccatcagcatgacatattatggacattatggagtggcccatgatcagagcccaaaacaccacatcccagctcctcccgctccatgcagcctcctagctctgccccccttcccagccaggcctttgacaaatgagtggtctgcacttaacttctcccttcctctcctcttcatgtccagatattcctcccacagctctaacacattgctcccaacaaggccactaacaacctctgtgctgtcagagaagtcataaacatcgtcttatcttacccaagctgtcagcggccttcacaatcgttgaaccctacctccaacttgacatgttctctgctcttggcttctgagacaccatgttctctggacatctcttgccagttctttttttttttcttttggggagggagtggtagggacagacagactcctatccctctgcataacttctcaaagttagggttctttagcacttagaacctggctcttttcattagccaggtgtggtggtccatgcttgctacttgggaggctgacatgggaggatcacctgagcctaaggaggtcgaggctgcagtgagcagtgatcacaccacagccttccagcccgggcaacagagtgagaccctgtctcaaaaattaaaaaa

SEQ ID NO: 47055 - DNA, 347 bp, Homo sapiens
gagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggct

SEQ ID NO: 47056 - DNA, 412 bp, Homo sapiens
tttctcacctcttattcactggtagacaatacagtgaatacaggatggataccatcccagtcaccattgcaactgacctggccacagtcacccttgtcctactgattgccaaatacaaaggcctatgctcagacttcctcctacttgccttttctgcaggattgcctccctcctttgtgaagccttcttttgccatgactgacttatctcttccttttggctctttgacttctgctggccccttaaatgctgttgtgctcaaggctttatccttggtatcttgggtccatttgggtcctatccactttcaagtattgcactactagccacattttgatgccctctcaacctccatatttagccatgacaccctgtgtcagtcagggttctccagagtaacaacaggacatag

SEQ ID NO: 47057 - DNA, 430 bp, Homo sapiens
cagaagtgtgtgaacaaaagagctagaagatgacttgtggtgatcagagacagcttcaaaaacaagggtgacatttggtctgagtttgatgtatttaagaaagttgccaggaaaataaggggataaatgccatcaagtcaaaaataaagattccagagggaaaaagacttggcttttgtggcgggggatgggagggtgggaggcgttgataattaaatttagattggatatgttggggatatctgggggacttaatgaatttggagctcagtttactttgtggtaaaatgaggtggaatgcttattctttagaggggggaggagaggtcaggagactgcaacagactgtaagagaatgttattaataaaaatcgtggagatagggagtttagatttggaagagactttagccatcacctacatcaatttt

SEQ ID NO: 47058 - DNA, 128 bp, Homo sapiens
aatattccagtgtacgtctaaatcatgttattgaagtagacctctctgaggggcatttgtgttgtttccaaccttctgccattacagtgctgcagtgaataactggatgtgtggtctacttcacacag

SEQ ID NO: 47059 - DNA, 243 bp, Homo sapiens
cctgatttctggcttgagcagctgcctgcttgctaatccctataatgagtgagaatggtggagaagctattttggaggagagaggaagtggtagcactgtatgccctttatagtgggaaattgggaaatacgagttgatatgccagaataaggggaaagtgagacaggggcagggcatgcattgtgaaatgaacatgaaaacacatgacagaaacaagtgaacagttaggtgataacacatct

SEQ ID NO: 47060 - DNA, 591 bp, Homo sapiens
gctgaaaatccaaaagaaactttaatttcagatatttaatgaaatcattatagctgtggtaatttcctttagctgggtgtgagtgtgtgatgtgagcgtgtggtgtgtgtgtgtgtgtgtgtgtgtgtgtgtgtgtgtgtactctggcagcatattccaaataatttctgtaaaatttcagtttgaaattaatagaagacatattaaattgtttaaactctttgttatttaaattctatattactttagtcgattactctgtattattacggcaaagctttgatatgttgccctgaatttaaagaaaaggctgttcggcctaaaaacaggaatattttattaccaaaaagaattaactaccatatgtcatttacagaaaagagtaaattcttcagggcatagaaaatacacatttccttctgtttgtgtggaaataagcaaaatacctgttataatagattcctcacagaattttgtgaagcttcaggtaaacttgaaagagaaaaattaaaatgctagagtttcataattacaaattgggatataaaaatagaataattatttgaattttgtatttctctccaggggatc

SEQ ID NO: 47061 - DNA, 415 bp, Homo sapiens
acatattcaagaaaaaagctaacttaaatggttgattgcataaacaataaattttagcaatacccagattagaactaacattatttgaagactcacttgctaatatatttatcatttcagaccatacacacaacccataaaatattagtgggctgatccaagcaaagcataagttggtgtttaaagtaagttgagtggaaagaaagctataaatctgttacaactctccttatgcatatataaaatggaaggtattattaaaatccccattccttttagcaaaggatttgaaatggttttgaataattcatcaaaacataaaacattgtatgaattaaaacaaaatcataacctaggaaaaaatatattaagcaaaatatcaagagatggaagaaagaaaataccatggattgca

SEQ ID NO: 47062 - DNA, 388 bp, Homo sapiens
gtgtttaaaatatgttgccctgccctgaagtcaaatttcacattttaaatactataagttagtttttgataaatatctgtcggattataatcttttccactccaatttgagtattatggtttaactgatatacttttctgcaatttttctttgtcttttgataaattcctgtttaccaatgttaaatgtatcattttcccattttaattttgatatctttcatgctgaaaatcaatgacatagtctctactatgatttttgccctataaaagtcaagtaacagtgaatagaaaaaactacccttattacaacccatatacatttttctttaccttttacattactagccttataaaggtttaaatgatgagtactttaaaactgttac

SEQ ID NO: 47063 - DNA, 341 bp, Homo sapiens
agaactcttagcttgtatagattaaatattagcataaaacgtatttactgtgccaacagttataaatgctgtcactttttaagctaaccatacttttttggggttttgttaatgtttattggcctctagatccatctagatttgatcaaaagtggtactttatcagggagccatagttaggaacacggtagaaatatctgcatttattaactaatatacaagtctgcctaggatcaggtatagtattccctaccttaccgggaagagaagtttgagccttttatatgtttataacacatggatttttgcctgatttttccaattttctattctgtatatga

SEQ ID NO: 47064 - DNA, 444 bp, Homo sapiens
acagctgggtcatttgaccttgaccttctgtgtcttctataaatagaatggtaacaactaccatgattagtgagctgactatgtggtagctagtgtttttcttactctacctgtagcctctccatgctcctgtgagatgtgttattcctatcttacagatggggaaatggaagcacagagaggccaatacacttgttcaaggtcacacagcccgtaagtggtaaggccaggacttgaatctgagcagtccagctacagagcccacatgctgagaccaccgtgctgtgcaattttctggcaggtgatgctgatgacaatgatgacacttttgacacagcgctttggtgagcgccacatgcattaatatgtgggaacctgctctgccagctaaaaagtgatggacccatatgaactctgacttaggtacaagttgagggagaggga

SEQ ID NO: 47065 - DNA, 488 bp, Homo sapiens
acagctgggtcatttgaccttgaccttctgtgtcttctataaatagaatggtaacaactaccatgattagtgagctgactatgtggtagctagtgtttttcttactctacctgtagcctctccatgctcctgtgagatgtgttattcctatcttacagatggggaaatggaagcacagagaggccaatacacttgttcaaggtcacacagcccgtaagtggtaaggccaggacttgaatctgagcagtccagctacagagcccacatgctgagaccaccgtgctgtgcaattttctggcaggtgatgctgatgacaatgatgacacttttgacacagcgctttggtgagcgccacatgcattaatatgtgggaacctgctctgccagctaaaaagtgatggatcgttttgaacccgggaggaggttgcagtgagcagaaatcgggccactgcactccagcctggggggcagagggagactctgtctca

SEQ ID NO: 47066 - DNA, 1240 bp, Homo sapiens
ttgttttgctattacaaacaatgctacaatggatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtggggtggcagcagctcagatattttccctcctctgtttttcataggctttttgtaatcgtgttataatactttaatggaaaaaaataaatttattattttaaagctataaaaattataaatcagtcattatgatgtgtttttctctactgagccctctggtgtgttccctgttttattaacgtggatggagggtgtgtcagggaggttgggacagaggcagagaagaggccagcccggccttcggggagttcgtggcctgtctggaaagagggtcttttacataccagcagtttgcagagccagacacagaacgatagagcaggaccttttaaactcctttttca

SEQ ID NO: 47067 - DNA, 931 bp, Homo sapiens
  misc_feature (931)..(931): n is a, c, g, or t
ttgttttgctattacaaacaatgctacaatggatgatgtttgcaaataaataatataaaataataaggccaggtgtggtggctcacacctgcaaacccaggaccttgggacactgacgtgggcagattgcttgagcccaggaatttgagaccagcctcggcaacatggtgagaccctgtttctacaaaaagtgtaaaaatcagccaggtgtggtggcacatgcctataatcccaggtactcagcaggctaaggtgggaggatcacctgagcccagggagtttgaggttgcagtgagctgtgatcacaccactgcattgtagcgtgagtgacagagtgagaccctgtctcaaaaagcaaataaacaaataaaatcaaaataataatagggaaatgcccttggtccacagactcagctgtcttccagatgctagtcattggtgaatgaacaacaagagagcctgcactgtcttgtgtgaaggtctaggtattttgggtctttgtcttgataaaatcagaatagacgtggcctctcactatcagctaggaagcagtttgaacttggagtatcagagggttgctctttttgccaagcctctggcttcaatccttgcctggggatggcagtgctgctgagggaaggaagtggggaacactgtgagtgcaaggacaggtgaggcaggcacagacggctgtcccaagggaaagtgctccatcagctgtgccaggagagaagcagctcttgggtccgtgtttctgccttagaaggcaggagttgggcatctagctccagcactcatccctcttgaaactgctggtttgtttactttcattgcaactatatgcctggaagagatgaagagaaagctcaacaggcttcactaggattgtttgggtgcgatctcagctcacaatcactagtgaattcgcgcn

SEQ ID NO: 47068 - DNA, 353 bp, Homo sapiens
aatatacatgtataacaaggaataaattttttaaacgttataattttgataatttataaaattttaaaatgggaaaaacaacctgtatgtggtgtagacatatattatgcaagtgtaagtatattaaattgtgtgggaataacagacatcaaattaggatagtagttatcctaagaagtggacgaggggtgccaggtacacggatgcataactgtgttgccgatatgtatcatattatgccatatattccagttatttcaaaataatgctatttctaacattcaaaaaatgagtttacaaattgattaaacatgtttatattttatgtttttatatttctactttataaatac

SEQ ID NO: 47069 - DNA, 203 bp, Homo sapiens
aagcagtagtgaatgacacaagtggagaaaacaaatctggcgcagcagacattgcagcaagccagcatgtgatggtctgtgccctccaggaactcgggagcctggtgcagagcttgaatgccaccgcatcccctcttattcaagaagcatctatagggcttttggagattgtgacttcagtgctgcttcatccaagcatggct

SEQ ID NO: 47070 - DNA, 776 bp, Homo sapiens
  misc_feature (199)..(199): n is a, c, g, or t
caggctttgccatttatgcttcagactcgtttttcgtggggatttgcaatcgaatacaattttgtcacaggtcctcagccatgtccatgatagggtcaagctctaatgagcctcggtataggacaagctggtacgccccagagaaccggtccgtatttcccgggtcggccactggttgtaataaattggcggccgcgtngacataaaggtgtgaaagtgatcttacaatgtaccaatcctagttaagtacctttaaaggaaatgtttattaaccttcaaacaataaatttaacacctgagaaataggaatatcttgcccatgcctcataagagtaattcagtgcatcatacaattatctgatttgattgattcatgattttttaaaaaagaaaaacaccttgcttctattaacataaaataattatatcacacaaaagtgccagagtttttgtatttttaaaagacatctatgggccaggagcggtgtctcacacctgtaatcccagcagtttgagaggttgagacagacggatcacctgagatcaggagttcgagaccagcctggccaacacggtaaaaccccatctctactaaaaaaaaaaacaaacaaacaaaaaacagaaattagccaagtgtggtggccgtacctgtaatcccagctactggggaggctgaggcgggagaatcacttgaacccagaaggcagaggtttcagtgagccgagatcgcgccatggcactccagcctgggcaacaagagcgaaactccatctcaa

SEQ ID NO: 47071 - DNA, 653 bp, Homo sapiens
ggccttctgccttcagaaatctccaggttttggcctcaacgttcatgggtgcctccaaactcccagcacacaagccaggttcttcaagagctttcccagggtcaccatgttctgctctactccgagggcacccccagtctcagagcacatccaagtctccacctagctttggggaggaagtcacctccccttgtgaacaccacattgactaacacttgccctctttctccttctttccctagctctctgcttatattacagaggggagctggggtgaaggctggggggagccagcaggacgagttctgaagcctcttattaagccttgagcaaggggtctagcccctctttaaaatgaggggttcctaattaacacccttcctttcaaatgcagcctggcctcccattcctcttccactttcttttccagctgcttttcaaagagcccaccttttggtgttgacttttcatggactccacttgtcagttgtaacagctaccctcacaagtgagccaaaggattcaaaataaggtttcctgtgagcacagtccataaggattgggatttgtatttatgaacatggaagaagcccagccccatagaagtgaaacacaaaagaacggaagagttttattaaatgctatggtctgaa

SEQ ID NO: 47072 - DNA, 420 bp, Homo sapiens
aaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtac

SEQ ID NO: 47073 - DNA, 560 bp, Homo sapiens
ccccattgatatgatctagtctgtgtcagaggtacaagcatgtaagttttttctaggatttttcctaggccaggctcagatctatgtaaaagagaccctggtcctgtcatcttaaatcagtaccctaattggcctgtgaaatttcacctttgatggtgagaatatgctgttctctataccgtgaccactacccctgcccggtatcagtgttagagatttcagggtgtatgtgtgtgtgttttgtttgtttgtttttgagatggagtttcactcttgtttcccaggctggagtgcagtggcacagtctcagctcactgcaacctctgcctcccaggttcaacaattctcctgcttcagcctccccagtagctggcattacaggtgcccaccaccacacccagctaattttcctatggtttagaaagtaacccttaaaatataatagccaggtgtggtggagcatgcctgtaatcccagtattttgggaggtagaggccaggagtttgagaccagcctgggtgacacagtgagaccctgtctctacccccaaaaaaaaaaaa

SEQ ID NO: 47074 - DNA, 482 bp, Homo sapiens
tcgacggagtctctcttcggaaaagattctccagaagagggctcagaactggccaacaggaaatttcacctttgatggtgagaatatgctgttctctataccgtgaccactacccctgcccggtatcagtgttagagatttcagggtgtatgtgtgtgtgttttgtttgtttgtttttgagatggagtttcactcttgtttcccaggctggagtgcagtggcacagtctcagctcactgcaacctctgcctcccaggttcaacaattctcctgcttcagcctccccagtagctggcattacaggtgcccaccaccacacccagctaattttcctatggtttagaaagtaacccttaaaatataatagccaggtgtggtggagcatgcctgtaatcccagtattttgggaggtagaggccaggagtttgagaccagcctgggtgacacagtgagaccctgtctctacccccaaaaaaaaaaaa

SEQ ID NO: 47075 - DNA, 326 bp, Homo sapiens
atatatggttaaagagccaagggagtgtctgtatgtataaaaagtgaatccaatttgaagacaccagacctaggcaaatccagaaaacaatctaatgcctcaggagaatatcatggatcaagctgacatggaaaggctctccatgtcatggaacaggaatgaaaacatcttatctgcttcttctaactctaaacatatacaactgctggataaaatgtaatttaaaattttttaatatatagcctaggctggaagcttagaaagtaaatcccagaaacgaagaggaaaccattcaataaatgaatggacctttcagaagtatttgg

SEQ ID NO: 47076 - DNA, 1856 bp, Homo sapiens
taatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccaggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctctttcacctttccctaaagaccctaaatctgaggaatcaacagggcagcagatctgtatatttttttctaagagaaaatgtaaataaaggatttctagatga

SEQ ID NO: 47077 - DNA, 3478 bp, Homo sapiens
taatttttgcccagtctgcctgttgtggggctcctcccctttggggatataagcccggcctggggctgctccgttctctgcctggcctgaggctccctgagccgcctccccaccatcaccatggccaagggcttctatatttccaagtccctgggcatcctggggatcctcctgggcgtggcagccgtgtgcacaatcatcgcactgtcagtggtgtactcccaggagaagaacaagaacgccaacagctcccccgtggcctccaccaccccgtccgcctcagccaccaccaaccccgcctcggccaccaccttggaccaaagtaaagcgtggaatcgttaccgcctccccaacacgctgaaacccgattcctaccaggtgacgctgagaccgtacctcacccccaatgacaggggcctgtacgtttttaagggctccagcaccgtccgtttcacctgcaaggaggccactgacgtcatcatcatccacagcaagaagctcaactacaccctcagccaggggcacagggtggtcctgcgtggtgtgggaggctcccagccccccgacattgacaagactgagctggtggagcccaccgagtacctggtggtgcacctcaagggctccctggtgaaggacagccagtatgagatggacagcgagttcgagggggagttggcagatgacctggcgggcttctaccgcagcgagtacatggagggcaatgtcagaaaggtggtggccactacacagatgcaggctgcagatgcccggaagtccttcccatgcttcgatgagccggccatgaaggccgagttcaacatcacgcttatccaccccaaggacctgacagccctgtccaacatgcttcccaaaggtcccagcaccccacttccagaagaccccaactggaatgtcactgagttccacaccacgcccaagatgtccacgtacttgctggccttcattgtcagtgagttcgactacgtggagaagcaggcatccaatggtgtcttgatccggatctgggcccggcccagtgccattgcggcgggccacggcgattatgccctgaacgtgacgggccccatccttaacttctttgctggtcattatgacacaccctacccactcccaaaatcagaccagattggcctgccagacttcaacgccggcgccatggagaactggggactggtgacctaccgggagaactccctgctgttcgaccccctgtcctcctccagcagcaacaaggagcgggtggtcactgtgattgctcatgagctggcccaccagtggttcgggaacctggtgaccatagagtggtggaatgacctgtggctgaacgagggcttcgcctcctacgtggagtacctgggtgctgactatgcggagcccacctggaacttgaaagacctcatggtgctgaatgatgtgtaccgcgtgatggcagtggatgcactggcctcctcccacccgctgtccacacccgcctcggagatcaacacgccggcccagatcagtgagctgtttgacgccatctcctacagcaagggcgcctcagtcctcaggatgctctccagcttcctgtccgaggacgtattcaagcagggcctggcgtcctacctccacacctttgcctaccagaacaccatctacctgaacctgtgggaccacctgcaggaggctgtgaacaaccggtccatccaactccccaccaccgtgcgggacatcatgaaccgctggaccctgcagatgggcttcccggtcatcacggtggataccagcacggggaccctttcccaggagcacttcctccttgaccccgattccaatgttacccgcccctcagaattcaactacgtgtggattgtgcccatcacatccatcagagatggcagacagcagcaggactactggctgatagatgtaagagcccagaacgatctcttcagcacatcaggcaatgagtgggtcctgctgaacctcaatgtgacgggctattaccgggtgaactacgacgaagagaactggaggaagattcagactcagctgcagagagaccactcggccatccctgtcatcaatcgggcacagatcattaatgacgccttcaacctggccagtgcccataaggtccctgtcactctggcgctgaacaacaccctcttcctgattgaagagagacagtacatgccctgggaggccgccctgagcagcctgagctacttcaagctcatgtttgaccgctccgaggtctatggccccatgaagaactacctgaagaagcaggtcacacccctcttcattcacttcagaaataataccaacaactggagggagatcccagaaaacctgatggaccagtacagcgaggttaatgccatcagcaccgcctgctccaacggagttccagagtgtgaggagatggtctctggccttttcaagcagtggatggagaaccccaataataacccgatccaccccaacctgcggtccaccgtctactgcaacgctatcgcccagggcggggaggaggagtgggacttcgcctgggagcagttccgaaatgccacactggtcaatgaggctgacaagctccgggcagccctggcctgcagcaaagagttgtggatcctgaacaggtacctgagctacaccctgaacccggacttaatccggaagcaggacgccacctctaccatcatcagcattaccaacaacgtcattgggcaaggtctggtctgggactttgtccagagcaactggaagaagctttttaacgattatggtggtggctcgttctccttctccaacctcatccaggcagtgacacgacgattctccaccgagtatgagctgcagcagctggagcagttcaagaaggacaacgaggaaacaggcttcggctcaggcacccgggccctggagcaagccctggagaagacgaaagccaacatcaagtgggtgaaggagaacaaggaggtggtgctccagtggttcacagaaaacagcaaatagtccccagcccttgaagtcacccggccccgatgcaaggtgcccacatgtgtccatcccagcggctggtgcagggcctccattcctggagcccgaggcaccagtgtcctcccctcaaggacaaagtctccagcccacgttctctctgcctgtgagccagtctagttcctgatgacccaggctgcctgagcacctcccagcccctgcccctcatgccaaccccgccctaggcctggcatggcacctgtcgcccagtgccctggggctgatctcagggaagcccagctccagggccagatgagcagaagctctcgatggacaatgaacggccttgctgggggccgccctgtaccctctttcacctttccctaaagaccctaaatctgaggaatcaacagggcagcagatctgtatatttttttctaagagaaaatgtaaataaaggatttctagatga

SEQ ID NO: 47078 - DNA, 1588 bp, Homo sapiens
attaaaaacttctgataaaattacctaagtacacacaaacaaaaacatgcccacacaaatcacttaatttctaaaacttttaatttttctgcttctctagtaccttgtattccatcacacagcaaaatctggcagctccacttccagaatttacttgaactccacagcttatttccgatttcctgttatcaccagagtctaaaacacagtttatattgcattcacctcctattttacaccgtaatttcctactttacactctaactttatataaaaaagaaactaccttttcaagatctaattcacgcaattttatttgttcttaattgagacttctttctaggtgctgtcacaccttgtaacgtcagatacaaatgtctctatccaatttcatgagttccagttattttattttaagggaatgtgtatatacatttataaatttgtgtatgtgtgtattcacttattctttattttatatgttttgcatgcatatattcactaaatccctgataatagaaagataacaaatctttttttttctttcttttttgtatgtaaattattttccgaaggaggtgggttgggagaaatatatcttaacttggcaagtttaaaagagaaagtggccattactaatgaaaattattctctagcattttcatgtttatctttaatagcattgctgatgacatattccctcttatcagttgtgtaggtgccattcactgcaatatactggccatccgcactggcaacgactttgctgccattaagctacaggtgataaaattgatctatctcatgatatggcattcgttggtgattatctcacctgtagtgactctggcattcttccctgcatctctgaaacaggggagcttacactttctattaatcatatattttgtattattgttgacaccatggctggagttttcgaaaagtggaactcatcttcctagcaacacaaaaataattccagcatggtgggtaagtatggatgcttatcttaatcatgctagtatatgctgccatcaattctcctgcttgtcagcagtgaaactgcagctgtcaaatgaggaattgataagagacacgaggtgggacatacaatcctacactacagatttcagtttttagaaaatgtgataataatattgatatttagtttctttggagggaacgttttaccgaagtgttgtgactcaataattgccgtgtagttcatcaaaacctacatattagcctttggctttaagctccgcttctgtcagtatttgcaaccaaggtggtcgggcaaagtattgccaggagatactgaaaatcatccagaagcactgtgatattgtgtaagcatctggagaaaattcagttaaaagaataaaagtaagcagctgaggaattactatcactcatggagaagggtaggatattttcaataagtgagtatgcaatatccatatatactttcacagaacaaagagtaaagaggctgagtgtgactttataaagatactcatgaaaaatataaacaacaaaaccttggaagtagtttctaataaaattgatttttctaaaaaaaaaa

SEQ ID NO: 47079 - DNA, 265 bp, Homo sapiens
gcctttagagccctagatgtgtattatatctcttcataagacaatatctcaatactttaatatttgaaacatcaccgtcaaagaaagcaaaacaaatggcacgtggtgtccttcacacttgctctgtgagtagattccacccaggccccctgggcatttctggggctcctgaaggcacctgattctgcagttggtacagtggtcttgggcctcctctgcctaatactagagacttcttccttaaggtctttggggctcttggtct

SEQ ID NO: 47080 - DNA, 405 bp, Homo sapiens
ttttttaactctataaaggcaaattaactttttccagtgataaatggtagcagaggactggtgttacaacacttgtacttaattaggaatttatttcagtctgacaatatcaactacagtatgccttccagtaagtaaatgaggtctttatgttaaagtctgaccaaatcatggttagaatgcaaaacttactttttaatagtaggaagaaggataaagaccttaaactcaggacagatgaaacatggcttgatgaatttatacctcttatctgtcttctcaaagatctccaaaaaacaaaagtacagttaacacactgcaaggagttgtaggacagaacctacaatatccctacttccttatccttcctcttccaatacacaaaaacgaatactgaaagggtta

SEQ ID NO: 47081 - DNA, 1458 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggagtaagcccaaagccgctgcaatcttcccgccccagcccgtctaagcggccctgcggggcctcccccgcccgggagcgggaggtggaaaagtcggccctaggcggcgggaaactgccggggggcgccaggaggtcctccccggggaggatcccaaatctgaaaaagcgaaaaggcttggagctaaaggtggtggccaaggcccttctcggccccttccagttcgtctgtaattccctggcgcagctccgggaagaggtgcacgaactgcaggcgcggtggttccccagcagaaccactctgcatcggggaattgaaaacaaggaattccccaaccaaacaggggcacaggctgtgtttgcagctcctgtaaaagctccatacccagagccgtgtctcccagctcccagccgtctttgtggcaattctacattggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttcctcgctgggccttggctgccttcccacggggcagggctcgggacctgcagcccgacatgcctgagcctcctacccaatccatggggctcctgtgcggcctgagcctccccgaagaacaccaccccctgctccacggcgcccagtcccatcgaccacgcaagg

SEQ ID NO: 47082 - DNA, 1051 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggaccgtctttgtggcaattctacattggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttcctcgctgggccttggctgccttcccacggggcagggctcgggacctgcagcccgacatgcctgagcctcctacccaatccatggggctcctgtgcggcctgagcctccccgaagaacaccaccccctgctccacggcgcccagtcccatcgaccacgcaagg

SEQ ID NO: 47083 - DNA, 1139 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggattcgtctgtaattccctggcgcagctccgggaagaggtgcacgaactgcaggcgcggtggttccccagcagaaccactctgcatcgccgtcttggtggcaatccttacattgggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttcctcgctgggccttggctgccttcccacggggcagggctcgggacctgcagcccgacatgcctgagcctcctacccaatccatggggctcctgtgcggcctgagcctccccgaagaacaccaccccctgctccacggcgcccagtcccatcgaccacgcaagg

SEQ ID NO: 47084 - DNA, 1162 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggagtaagcccaaagccgctgcaatcttcccgccccagcccgtctaagcggccctgcggggcctcccccgcccgggagcgggaggtggaaaagtcggccctaggcggcgggaaactgccggggggcgccaggaggtcctccccggggaggatcccaaatctgaaaaagcgaaaaggcttggagctaaaggtggtggccaaggcccttctcggccccttccagttcgtctgtaattccctggcgcagctccgggaagaggtgcacgaactgcaggcgcggtggttccccagcagaaccactctgcatcggggaattgaaaacaaggaattccccaaccaaacaggggcacaggctgtgtttgcagctcctgtaaaagctccatacccagagccgtgtctcccagctcccaggtgaagtcttatgtatacatggggcattggcccaggtgactccatactagtatcctaggccatctagtagctcctaggtctgggctcttgcaaaaagcttgcaattcatcaagggttgagctgcacattggggcttttagatgtgctgctgaggaagtgatttcctgcatttaatcatcttccgatgaatgctagagaaactgatctagagtggctcctcttggttagaactagctgaagcatactgtatatacttactacttttaaaaatttcatataaaggaatagaaaataatactggaaaaaaaacaaaaaaggtcacaatcttccataattccatcactcttaccaattacctgaagttaaaaaaccctctcaagtttctccctttgcttatcaagccctgctgcagagaggtaagctc

SEQ ID NO: 47085 - DNA, 1356 bp, Homo sapiens
gagggtgtggggggctgtgcgtggggctgccctcaccggaagctgcacgctcggggaagcgcggaggcgggggtgctgcgcgcgctggggagcacgtggggggacacgcagggactgcccgtgcgaatggcttccaacgcatgcgccccaccctacatttcacagtcgccatgacgaccaggaggtccgctagtcaacggctcgtcaacggctgcggggacaagtccgttgaggctgccaggcgagtcaggcctttctggacctcgcctgactcggctgggctgtgcctgaaattgacccagctccactaggaattatgaagaaacaaggagtaagcccaaagccgctgcaatcttcccgccccagcccgtctaagcggccctgcggggcctcccccgcccgggagcgggaggtggaaaagtcggccctaggcggcgggaaactgccggggggcgccaggaggtcctccccggggaggatcccaaatctgaaaaagcgaaaaggcttggagctaaaggtggtggccaaggcccttctcggccccttccagttcgtctgtaattccctggcgcagctccgggaagaggtgcacgaactgcaggcgcggtggttccccagcagaaccactctgcatcgccgtctttgtggcaattctacattggttacatttagtaacactttttgaaaatgatcatcatttctctcacctctcatctttggaacgggagatgactttttgcattgaaacggttaggtttcttcttctaacgaattaatttgtggtttaagaatagccagaccgagaggtgacagcatgctggcagtcctcagagcccttgcttgctctcggcacctcccctgcctgggctcccgctttggtggcatttgaggagcccttcagtcccccactgcactgtgggagcccctttctgggctggccaaggccggagcccactccctcagcttgcagggaggtgtggagggagagacacgagcgggaaccggggctgtgtgctgcacttgcgggccatctggagttccgggtgggcgtgggcttggtgggccccgcactcagagcagccagccagccctgctggccccgggcaatgggggacttagcacctgggccagtggctgcggagggtgtactgagtcccccagcagtgctggcccaccggcgctgcgctcgatttcctcgctgggccttggctgccttcccacggggcagggctcgggacctgcagcccgacatgcctgagcctcctacccaatccatggggctcctgtgcggcctgagcctccccgaagaacaccaccccctgctccacggcgcccagtcccatcgaccacgcaagg
